United States Patent 9,254,311 (MODIFIED POLYNUCLEOTIDES FOR THE PRODUCTION OF PROTEINS) - sequence listing, part 8

SEQ ID NO: 8659 - DNA, 1626 bp, Homo sapiens
atggctgcaaattggacactctcatggggtcagggaggaccctgcaacagccctgggtcagacactccacggtctgtggcgtccccagaaactcaacttggaaatcacgacaggaaccctgagacttggcacatgaatttcaggatgttcagctgcccagaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcaaggtgaacggtgtgcagagctgcaaagacctggaggacctgctacgaaataacagaagacccaagaaatggtctatagtcaacttgctcggcaaagaatatcttatgctgaactcagatgtcgagatggctgaagcccccgccagtgtcagagatgatccgagagacgtgtccagccagtgggcctcctctgtgaaccagatgcatccggggacaggccaggcccgccgagagcagcagatcctgcccagggtcgctgcactgtccaggaggcagggagaggactttctgctacacaagagtattgacgtaacaggtgacccaaactctccgagacccaagcagaccttggagaaggatctgaaggaaaacagggaagagaacccaggactgtcatccccagagcctcagcttccaaagagtcccaatctggtgagagcaaaggaggggaaggaaccccagaaaagagcctctgtggaaaatgtggatgctgacacaccttctgcctgcgttgtggagagagaagctttgactcacagcgggaacagaggagatgctctgaatctgagcagtcccaaaagaagcaaaccagatgcctcctccatttcccaagaagagcctcaaggagaagccacacctgtgggcaacagagaatccccaggacaagctgagatcaatccagttcattccccaggccctgcgggcccggtcagtcacccagatggccaagaagccaaggccctgccgccctttgcatgtgacgtgtgcaataaatcatttaagtatttttcccagctaagcatccacaggaggtcacacacaggagacagaccctttcaatgtgatctctgtcggaagcgcttcttgcagccctcagacctccgagttcaccagcgagtccacactggcgagaggccctacatgtgtgacgtctgccaaaagcggttcgcccacgagtccaccttacagggccacaagaggatccacaccggggagaggccgtttaaatgtaaatactgcagcaaagttttcagccacaaggggaacctgaacgttcaccagcgcacccactccggagagaagccctacaaatgtcccacctgtcaaaaggccttccgtcagctggggacattcaagcgtcacctgaaaacacaccgggaaaccacctcccagtgattccagagtcaggtccacatcctccaccccaagagacagtgaatgatggtttttctccaatgttaccagatgacatatacacataaagcacttggtaggaattgcccggatgtttgaataaatatttatcctccccca

SEQ ID NO: 8660 - DNA, 1491 bp, Homo sapiens
atggctgcaaattgcacatcctcatggagtctaggagaatcctgcaacagccctgggtcagagccaccacagtccatgccatccccagcaactcaacttggaaatcatgacagtgatcctgagacttgtcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtagtcagttttcttggcaaggaatatcttatgcaggaatcagatgtggagatggctgaagcccccgccagtgtcagagatgatccgagacacgtgtccagccagcggacctcctctgtgaaccagatgtgtccggaggaaggccaggccagccaagagctgcagaccctgcccagggtccctgcactgttcaggaggcaggaagaggacttcctgctgccagagactactgtcatgaaaggtgacccaaaggctctgagacccaagccgaccttggagaaggacctggaggaagacagggaggagaacccaggacttacatccccagagcctcagcttccaaacagtcccacaggggtggtgggagcaaaggaggggaaggaaccccaaaaaagagcctctgtggaaaatgtggatgctgacacaccttctgcctgcgttgtggagagagaagcttcgactcacagcgggagcagaggagacgctctgaatctgagaggtctcaaaagaagcaaaccagacgccacctccatttcccaagaagagcctcaaggagaagccacacctgtgggcaacagagaatccccgggacaagctgagatcaatccagttcattccccaggccctgcgggcccagtcagtcaccccagtggccaagaagtcaaggaactgctgccctttgcatgtgaggtgtgcggcaagaggtttaagtatcgcggcaagttagccgtccacacgagatcacacacaggcgagagactctttcagtgtaatctctgcgggaagcgcttcatgcagcgcataggcctgcaatttcaccagcgaacccacactggcgagaggccctacacgtgtgacatctgccagaagcagttcacccagaagtcctacttgaagtgtcacaagagaagccacacaggggagaagcccttcgaatgtaaagactgcaagaaagttttcacctacaaggcaaatctgaaggagcaccagcgcatccactctggagagaaaccccacaaatgttccaagtgtccaagagccttcggtcggccggcgaccttaagacgccaccagaaaacacatcgagaagccacttcacagtga

SEQ ID NO: 8661 - DNA, 1892 bp, Homo sapiens
ggaggcagaagtcaggaaggagacttctgaatgaacagtgaatctattactgagaaaaaccaggggtggcctgtgtatataggtcgcaattagacaccggcttctggaagagctttcccagagacagattgaaatattccccagtagacatggctgcaaattgcacatcctcatggagtctaggagaatcctgcaacagccctgggtcagagccaccacagtccatgccatccccagcaactcaacttggaaatcatgacagtgatcctgagacttgtcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtagtcagttttcttggcaaggaatatcttatgcaggaatcagatgtggagatggctgaagcccccgccagtgtcagagatgatccgagacacgtgtccagccagcggacctcctctgtgaaccagatgtgtccggaggaaggccaggccagccaagagctgcagaccctgcccagggtccctgcactgttcaggaggcaggaagaggacttcctgctgccagagactactgtcatgaaaggtgacccaaaggctctgagacccaagccgaccttggagaaggacctggaggaagacagggaggagaacccaggacttacatccccagagcctcagcttccaaacagtcccacaggggtggtgggagcaaaggaggggaaggaaccccaaaaaagagcctctgtggaaaatgtggatgctgacacaccttctgcctgcgttgtggagagagaagcttcgactcacagcgggagcagaggagacgctctgaatctgagaggtctcaaaagaagcaaaccagacgccacctccatttcccaagaagagcctcaaggagaagccacacctgtgggcaacagagaatccccgggacaagctgagatcaatccagttcattccccaggccctgcgggcccagtcagtcaccccagtggccaagaagtcaaggaactgctgccctttgcatgtgaggtgtgcggcaagaggtttaagtatcgcggcaagttagccgtccacacgagatcacacacaggcgagagactctttcagtgtaatctctgcgggaagcgcttcatgcagcgcataggcctgcaatttcaccagcgaacccacactggcgagaggccctacacgtgtgacatctgccagaagcagttcacccagaagtcctacttgaagtgtcacaagagaagccacacaggggagaagcccttcgaatgtaaagactgcaagaaagttttcacctacaaggcaaatctgaaggagcaccagcgcatccactctggagagaaaccccacaaatgttccaagtgtccaagagccttcggtcggccggcgaccttaagacgccaccagaaaacacatcgagaagccacttcacagtgacttcaccatcgggtctgtcttctgcaccaagaaagtgtgaatgaagatttttcaccgatgttgtcagatgacgtttgacagatgaagggcgcctggcacgcagaggagtgccctagataggaattcctaggatgtttgtttaaatctttttcctccccgggggaattttggtttttgtttcattatttctattgttttaggtttattttggtttgtgttgctgttctttcaataaacatcttattagttttc

SEQ ID NO: 8662 - DNA, 2849 bp, Homo sapiens
atccggcggtggtgacgcgagaggctggggtctccaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagcaatgtaataattaaaacaaaagtctaagatttgaagagataatttgcttcaggattttgatggaaggcaaatgctaactttaaaaaccagatttcggagaagtacaaaagaaatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcaggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaa

SEQ ID NO: 8663 - DNA, 2512 bp, Homo sapiens
agccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaa

SEQ ID NO: 8664 - DNA, 2741 bp, Homo sapiens
agagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagcttttatttttatgtgataatctacctttaagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttcatctctggtatttgggggatttaaataaaatgattccatttttttatactatttagattttaagaaggctaaagaatcaaacgttttaaacata

SEQ ID NO: 8665 - DNA, 2208 bp, Homo sapiens
atgtcgcacgcgtacttcatacaccatagagtatggttccgggtctgctggctagagcgtcacttcttccgcaggaagcggaagagcgatcgggtaggcggctctttgtcgaagctagaggaccggcaggcggcagcagcaactacggcggcggcggcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccaccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaatcacaatgagccacaccaccactcccatggtgacttaccctatcgcttcccagagcatgcgcatcacggccatgccacactgatggggctaatggacactcccctggtatagcctcgcagggctggggtcagggggcccttgcccactcacctagccttccccatccctgtctgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaac

SEQ ID NO: 8666 - DNA, 743 bp, Homo sapiens
aaggccccccagaaccgagctggctcgtcctcacaccccagggcagtgccccttttctgagtgaccccgcatcgcgagcaaacgccagcttcgtgacgtcacaaccctgcccatcccctcagcttgatgacacctggagctccagctccccgcttcacttcgcgcgcccttagtgtcccattcacgtagcccacggctgagcgccggcggcactgcacggaacctgccaagctagaagacttgctgcgggaaaactcctaggacttctttcgcaaactctagggtgttgggaagcgtcacaatcactgccttcaagtctaatcggccatcccaatgcactgtcagacgctgcctttttgagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccg

SEQ ID NO: 8667 - DNA, 1019 bp, Homo sapiens
gagggaggcgggagacttaggtggaggccgcgcccggaggggaggagtcggggccggcccagcggctgggctcggccaggccacagaaggccccccagaaccgagctggctcgtcctcacaccccagggcagtgccccttttctgagtgaccccgcatcgcgagcaaacgccagcttcgtgacgtcacaaccctgcccatcccctcagcttgatgacacctggagctccagctccccgcttcacttcgcgcgcccttagtgtcccattcacgtagcccacggctgagcgccggcggcactgcacggaacctgccaagctagaagacttgctgcgggaaaactcctaggacttctttcgcaaactctagggtgttgggaagcgtcacaatcactgccttcaagtctaatcggccatcccaatgcactgtcagacgctgcctttttgaggttcctcactagccattactaactccagcccttggcggtgctctgaccctcacatcctctttcatcttgaggcagggcgccccgcactctttgttcactcagggctggttttccaacccctcctcccagtccctccgaattagttttactcttcttactggcaacttctcccttggacaggtgaagttcagtttgaaccctgaggaaatcctcacgttctcgaagctttgccgttttgtcagatttcttgtgacaaccaccccatagtcctccactcttactccttcttccacccaagtctctgtttttttcctgctcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttct

SEQ ID NO: 8668 - DNA, 552 bp, Homo sapiens
ctctttgtcgaagctagaggaccggcaggcggcagcagcaactacggcggcggcggcaggtgaagttcagtttgaaccctgaggaaatcctcacgttctcgaagctttgccgttttgtcagatttcttgtgacaaccaccccatagtcctccactcttactccttcttccacccaagtctctgtttttttcctgctcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgc

SEQ ID NO: 8669 - DNA, 7005 bp, Homo sapiens
acaccaaaaatggagaagagtgcctccaaggaagagaagcagcagcctaagcaggacagcacagagcagggcaatgctgattctgaagagtggatgagctctgagagtgaccctgaacagataagccttaagagtagcgacaacagcaagagctgccaacctagggatggtcagttgaagaaaaaggagatgcactccaagccacaccgccagctctgtcgatcaccctgcctagatcgtccaagtttctcccagaatcacttattaatgatgtattggcagagcttgtcagacttgggaacaaaggtgattcagaagggcagctccagagagattgcaagccctgaattgtctcttgaagatgaaatagataacagtgacaatttgaggccagttgtcattgatggaagtaatgtggcaatgagccatgggaataaagaagaattctcctgcagaggaatacaacttgctgtggattggtttctagataaaggccataaagatattactgtatttgtgcctgcatggagaaaggagcaatcccgccctgatgcaccaattacagatcaagatattctacgaaaactggagaaggaaaagattcttgtcttcacaccatcccgaagagtccaaggcaggagggttgtctgctatgatgaccggttcatagtcaaactggcttttgattctgatggcatcattgtgtccaatgataactaccgagaccttcaagttgaaaagccagaatggaagaagtttatagaggagcggttgctgatgtattcttttgtgaatgacaaatttatgcctccagatgatccattaggacgccacggcccaagccttgaaaatttcttaagaaagagacccattgttcctgagcataagaagcaaccatgtccttatggcaaaaaatgcacctacggccacaagtgcaaatactaccatccggagcgggccaaccaaccccagcgttcggtggctgatgagctccgcatcagtgccaaactgtccacagtgaaaactatgagtgaaggcaccctggccaagtgtggcacagggatgtctagtgccaaaggtgagataacctcagaggtcaaacgtgtggcccccaagcgccaatcagatcccagcatccggtctgtggctatggagcctgaggaatggctgtccattgcccgtaagcctgaggctagttctgtcccctcgcttgtgactgccctaagtgttcccacaatcccaccccccaaaagccatgcagtgggtgcactcaacacccgttcggccagcagcccagtgccaggatcctcccatttcccccaccagaaggcctctttggagcatatggccagcatgcagtatcctcccatcttggttaccaacagccatgggacccctattagctatgctgagcaatacccaaagtttgaatccatgggggaccatggctactattcaatgttaggtgacttctccaaactgaacatcaacagcatgcataaccgagagtattacatggctgaagtagaccggggggtgtatgcccggaatcctaacctctgttctgacagccgtgtgagccataccaggaatgacaactattcctcttacaacaacgtgtatttggctgtagctgatacccatcctgaaggcaatttgaagctgcaccgctcagcatcccagaaccgacttcagccttttcctcatggttaccatgaagccttaacacgagtgcagagctatggcccagaggattctaagcaaggcccccacaaacagtcagtcccccacttagctctgcatgcccagcacccatcaactggaacacgttccagctgtcctgcagactaccccatgcctcccaatatccatcctggggcaaccccccagccaggccgtgccctggtgatgactcggatggatagcatttccgactcccgcctctatgagagcaaccccgtgaggcaaagacgacctcccctgtgccgggaacagcatgccagctgggacccgctgccctgtacaactgactcctatggctaccactcctatcccttgagtaacagcctcatgcaaccatgttatgagccagtcatggtacggagcgtgcctgaaaagatggagcagctttggaggaatccttgggttggaatgtgcaatgattccagggagcatatgatcccagaacaccagtatcagacctacaagaacctctgcaatattttcccttctaacatcgtccttgcagtgatggagaagaatccccacacagcagatgcccagcaactggcagccttgattgttgctaagcttagggctgcacgttgatatgacatagtacttatttctttatacaaatatgaatattaatactaataatacactaatacaataattatagtaactaataatttgtgttgcgctttacaagttagagtgtttatatcatttaagcgcttaacaaccctgtgaggtacgtcttactaacatcctcttttatagagaaggaaggtgaaggtcagtgaaattaagtggctagccagggtcacactgctagcaaatgactaagtcaagacacacacccaagtcctctaaatccaagtcccatgcccctttgcactgcaccatgcaggtaatggaggacaaaacccagggggagaggtctagatgtaagaaatcccagaggattccattaccagagttttcctttttctcttttcgtttctttctttctttctttattttttttttttgagacagaatctcactctgttacacaggctggagtgcagtggcactatctctgctcactgcaacctccacctccagggttcaagtgattctatggcctcagcctcccaggtagctgggattacaggcgtgcaccaccatgcccagctaatttttgtatttttagtagagacgtggtttcaccgtgttggccaggctggtctcaaactcctggcctcaagtgatccgcccaccttggcctcctaaagtgctgggattacaggtgtgagccactgcgcccagcctaccagagttttcgtagtcacatattctatattacaaagtatggatgatatatccaatttagagagcaaaagcatcaggatcagatcatatgttgaattaaccttttaggttttttctaatagaaatatttaaagctatttaaaagtaaatgcatactttattgcatggatatctgatcactcaatctatattaatgaaactatagggtcacattgaagcttctagaactatattttaaagctattattagcaattatattgcatgtatgaatatatatatttggtttgagatgtgtgtgtatctctgtataaccttttatatagtgataatgagagggtaggctctacacagtccttcgtctatagctgtataggtcactaatctgacttgatgattttaagtcacatttcatagttttaactagttatgagagagaaattatatggcaatatttgaacattgctttcttaggcaccagagcaaagcaactctgtttcctttgcacattttacctgccaacatttattaacagttcttaccttccaagtctcttcaccttagcaaattagggatcaggttgcagtcttctgcagagaaactgatggttaagctcaagttccaagcatagtatgtgtgtgctacacaagctcagaagagtttgacaaggaccaggggacttactaccacaatccacttcccttatcccaggagagatggccaaacccatgtggcattaaatggtgaataaaaaagcttcactcaaggagggactattggatgctctttggacttctgacctatgcagtattcaacatcattggatgaaatgtaatggaggacagtgcacagccatgtatccactttctcttcctgtccaccctttgggtaataaggtcaatcattggtggaacagaatttctctaggaaacaaaaccaggggattttatttgtggaaaaaggaagtttccaaaaggggatactgcatctttactaatagctggctcagttactcactttaaatccatgcaaagagtgcacttgctgttaaataattgttaaatgagttattagaaggcaggacttttggtttgggcgacaccatttgcgcaacttgtatcttgctcagggtggaaaacttcatagctaaatgcctctagaagaggtgtttattgttttttttaagctgcactaaatgaattccctttttgaatccattgtatatttcaatatttcgaaccatgatcagctcactatttcctgagctggaacttgctaacttctatgatcgttttttcatgaaagttgagaaggccgggccttggccttttgtttcttcatgagaaggtgtgacactgcctataaatgtttcttactgtgaaacactctgaatgtgaggctgtagtcagggttgtttctggtggtttgacaatggcttgcatgctgctttctggctttctgtctctgtccaagttgatcaatactgcatcttaaccaatgtttcacttgagttaaccacagctttacattctatctcctatcttctgatcttcgtataccccagcatattgaaaaagagtaaaagtattttctatcaatcaggtagatccacagagtgacagttgccactgcagtgcttgctatttcacacaaacaccatttcataccttcaacttcttggactttctaaatcggactcgtgtctaaatcagggtatttgacaatctcagatgatgctactgcctatgtgccagttagttcatcttcctaccaagatcatgaatggcaccacactatccactagctgtacaatttacagagaagcacaagattcatcttgtcacctacaattcgtcttgaacatgttcatatttagtactcagaaactgtgtaagctcctcccaatacagaaaatattttttaaggcagcatatgtatttctgatttactaaaaacgattgtcattctcctctcattcttctttttggtatgaaccaaaagcggctaggagcaatgcctcaaataaccagaaatgaccttttgttgatacaaattgtatctctttttttcctgattgtatagaaacaaatgtacaaaactcatctgaagctaggtttggcactgaattttcaccatgaggtttgtggcactgtgtgtcacagggaagtagctcaggggttgtgagggagcttttatttctaaagggcagtagtaatttatagacaaaaacaatttttcaaggcctctttattaccactgcacagctatcatgtgtaaaatttcaagcattatattgcataagttctctttagcctattaaatttaatatgtccttgcaaaagggattttgtgtaaaaagtgtcagtgttagtgactcatctgcaagaatctacaaatggagctatacaactatgaatacataaatacagcatggttcctagttattagagaaacattttctttatattgaggtctacgcacttcttgactttccattttgtctgtaattataaaacagcaaataacaaagaagcattgggaccccctcggctgccttgataataaaatcaagcttccttcatgggactaagcatgtgtccttcaggatacttacctctaagcactcagcaggggttactacaaagcgttttgtgtggttttcaaaaaacagtgtattttgcaagaggtgctttgtaattttaattatttcactgattttctgacctcataggaagtctgtgcctgttgaggccttcaattttgtagcttttctgattttttttcttctttttgtgattttgttgttgttttcattttgatctaaaggagaagtgtgaccccggagtggcatggtcaatccagggcaccctttctgtaagacaactcaaaggaaaagaagccttttcaaaggtaatatcgagccattgcactctctcttaaggtgccaggtatgggagaatgacagatgccttatggaaatggtctacaaaacttttcttcttctaagtaataaaacacatagcatgattctctctccctctctctctctctctctgcccaccccctgctagtttccaggagaatacttctctaaaattcatttttttctattttggaataaattatctttatacagtaattcaaacactgatttccattaacctttggccctgagttttcttctaacatagaagagttcattttgagaggcactcagttaccattcaatctgtgctgtaagtatgggactttgtacaaatgccctttttgagggccaaaaatttcaatacactttgttctactttgtgaaccaggtctggatctgcacagagaaagtaatgctgagctgtccaaagagtccgctcaggtctccctcctaaccctcctctgccttcccctagtttgcttatcctcacgtctgacactgaggagtgcatagtcttcaactgaaatggcactacagttagttctcattggaaacaaacaagtgtatttctggaacctgctcgtctaaaatagtcaatgcctttgtaaagactcagcatattcaatatctattgtatggtagctagctatatacatagattgactatttttagtcctggtttgtgtattgttgagctatagtagtttgctttatccatttgtgggattaaacaatactgtttaatggttgtaaacttttataaaatctctttgggttttttgtttgacccaaacataatgtaagtcttaatgacaaaatacacaaagttaaccagaggtgagtgaaaatatagcccttccccagttttgtctgcccctataatgcacgtgcattgctttgtaatatgctctcgctagcatgaatgtgctatgactacttcatgaggttttgtttcacctataattgtgatggaaaatgctgtattgctgacaacaatgaactgtaaccacagttatttactgcataaactatttgtgtactaacc

SEQ ID NO: 8670 - DNA, 7256 bp, Homo sapiens
catgtggattccaagcaggctaaaaagaaaaagaactgattagacctcagacgacccactaaacgggatgacggccacagctgaggtagagacaccaaaaatggagaagagtgcctccaaggaagagaagcagcagcctaagcaggacagcacagagcagggcaatgctgattctgaagagtggatgagctctgagagtgaccctgaacagataagccttaagagtagcgacaacagcaagagctgccaacctagggatggtcagttgaagaaaaaggagatgcactccaagccacaccgccagctctgtcgatcaccctgcctagatcgtccaagtttctcccagagcagcattttacaggatggtaaacttgacttggagaaggaataccaagctaagatggagtttgcgctaaagctgggctatgcagaggaacagattcaatcagtgctaaacaagctgggcccagaatcacttattaatgatgtattggcagagcttgtcagacttgggaacaaaggtgattcagaagggcagatcaacttgagtctgttagtgcctcgtgggcccagctccagagagattgcaagccctgaattgtctcttgaagatgaaatagataacagtgacaatttgaggccagttgtcattgatggaagtaatgtggcaatgagccatgggaataaagaagaattctcctgcagaggaatacaacttgctgtggattggtttctagataaaggccataaagatattactgtatttgtgcctgcatggagaaaggagcaatcccgccctgatgcaccaattacagatcaagatattctacgaaaactggagaaggaaaagattcttgtcttcacaccatcccgaagagtccaaggcaggagggttgtctgctatgatgaccggttcatagtcaaactggcttttgattctgatggcatcattgtgtccaatgataactaccgagaccttcaagttgaaaagccagaatggaagaagtttatagaggagcggttgctgatgtattcttttgtgaatgacaaatttatgcctccagatgatccattaggacgccacggcccaagccttgaaaatttcttaagaaagagacccattgttcctgagcataagaagcaaccatgtccttatggcaaaaaatgcacctacggccacaagtgcaaatactaccatccggagcgggccaaccaaccccagcgttcggtggctgatgagctccgcatcagtgccaaactgtccacagtgaaaactatgagtgaaggcaccctggccaagtgtggcacagggatgtctagtgccaaaggtgagataacctcagaggtcaaacgtgtggcccccaagcgccaatcagatcccagcatccggtctgtggctatggagcctgaggaatggctgtccattgcccgtaagcctgaggctagttctgtcccctcgcttgtgactgccctaagtgttcccacaatcccaccccccaaaagccatgcagtgggtgcactcaacacccgttcggccagcagcccagtgccaggatcctcccatttcccccaccagaaggcctctttggagcatatggccagcatgcagtatcctcccatcttggttaccaacagccatgggacccctattagctatgctgagcaatacccaaagtttgaatccatgggggaccatggctactattcaatgttaggtgacttctccaaactgaacatcaacagcatgcataaccgagagtattacatggctgaagtagaccggggggtgtatgcccggaatcctaacctctgttctgacagccgtgtgagccataccaggaatgacaactattcctcttacaacaacgtgtatttggctgtagctgatacccatcctgaaggcaatttgaagctgcaccgctcagcatcccagaaccgacttcagccttttcctcatggttaccatgaagccttaacacgagtgcagagctatggcccagaggattctaagcaaggcccccacaaacagtcagtcccccacttagctctgcatgcccagcacccatcaactggaacacgttccagctgtcctgcagactaccccatgcctcccaatatccatcctggggcaaccccccagccaggccgtgccctggtgatgactcggatggatagcatttccgactcccgcctctatgagagcaaccccgtgaggcaaagacgacctcccctgtgccgggaacagcatgccagctgggacccgctgccctgtacaactgactcctatggctaccactcctatcccttgagtaacagcctcatgcaaccatgttatgagccagtcatggtacggagcgtgcctgaaaagatggagcagctttggaggaatccttgggttggaatgtgcaatgattccagggagcatatgatcccagaacaccagtatcagacctacaagaacctctgcaatattttcccttctaacatcgtccttgcagtgatggagaagaatccccacacagcagatgcccagcaactggcagccttgattgttgctaagcttagggctgcacgttgatatgacatagtacttatttctttatacaaatatgaatattaatactaataatacactaatacaataattatagtaactaataatttgtgttgcgctttacaagttagagtgtttatatcatttaagcgcttaacaaccctgtgaggtacgtcttactaacatcctcttttatagagaaggaaggtgaaggtcagtgaaattaagtggctagccagggtcacactgctagcaaatgactaagtcaagacacacacccaagtcctctaaatccaagtcccatgcccctttgcactgcaccatgcaggtaatggaggacaaaacccagggggagaggtctagatgtaagaaatcccagaggattccattaccagagttttcctttttctcttttcgtttctttctttctttctttattttttttttttgagacagaatctcactctgttacacaggctggagtgcagtggcactatctctgctcactgcaacctccacctccagggttcaagtgattctatggcctcagcctcccaggtagctgggattacaggcgtgcaccaccatgcccagctaatttttgtatttttagtagagacgtggtttcaccgtgttggccaggctggtctcaaactcctggcctcaagtgatccgcccaccttggcctcctaaagtgctgggattacaggtgtgagccactgcgcccagcctaccagagttttcgtagtcacatattctatattacaaagtatggatgatatatccaatttagagagcaaaagcatcaggatcagatcatatgttgaattaaccttttaggttttttctaatagaaatatttaaagctatttaaaagtaaatgcatactttattgcatggatatctgatcactcaatctatattaatgaaactatagggtcacattgaagcttctagaactatattttaaagctattattagcaattatattgcatgtatgaatatatatatttggtttgagatgtgtgtgtatctctgtataaccttttatatagtgataatgagagggtaggctctacacagtccttcgtctatagctgtataggtcactaatctgacttgatgattttaagtcacatttcatagttttaactagttatgagagagaaattatatggcaatatttgaacattgctttcttaggcaccagagcaaagcaactctgtttcctttgcacattttacctgccaacatttattaacagttcttaccttccaagtctcttcaccttagcaaattagggatcaggttgcagtcttctgcagagaaactgatggttaagctcaagttccaagcatagtatgtgtgtgctacacaagctcagaagagtttgacaaggaccaggggacttactaccacaatccacttcccttatcccaggagagatggccaaacccatgtggcattaaatggtgaataaaaaagcttcactcaaggagggactattggatgctctttggacttctgacctatgcagtattcaacatcattggatgaaatgtaatggaggacagtgcacagccatgtatccactttctcttcctgtccaccctttgggtaataaggtcaatcattggtggaacagaatttctctaggaaacaaaaccaggggattttatttgtggaaaaaggaagtttccaaaaggggatactgcatctttactaatagctggctcagttactcactttaaatccatgcaaagagtgcacttgctgttaaataattgttaaatgagttattagaaggcaggacttttggtttgggcgacaccatttgcgcaacttgtatcttgctcagggtggaaaacttcatagctaaatgcctctagaagaggtgtttattgttttttttaagctgcactaaatgaattccctttttgaatccattgtatatttcaatatttcgaaccatgatcagctcactatttcctgagctggaacttgctaacttctatgatcgttttttcatgaaagttgagaaggccgggccttggccttttgtttcttcatgagaaggtgtgacactgcctataaatgtttcttactgtgaaacactctgaatgtgaggctgtagtcagggttgtttctggtggtttgacaatggcttgcatgctgctttctggctttctgtctctgtccaagttgatcaatactgcatcttaaccaatgtttcacttgagttaaccacagctttacattctatctcctatcttctgatcttcgtataccccagcatattgaaaaagagtaaaagtattttctatcaatcaggtagatccacagagtgacagttgccactgcagtgcttgctatttcacacaaacaccatttcataccttcaacttcttggactttctaaatcggactcgtgtctaaatcagggtatttgacaatctcagatgatgctactgcctatgtgccagttagttcatcttcctaccaagatcatgaatggcaccacactatccactagctgtacaatttacagagaagcacaagattcatcttgtcacctacaattcgtcttgaacatgttcatatttagtactcagaaactgtgtaagctcctcccaatacagaaaatattttttaaggcagcatatgtatttctgatttactaaaaacgattgtcattctcctctcattcttctttttggtatgaaccaaaagcggctaggagcaatgcctcaaataaccagaaatgaccttttgttgatacaaattgtatctctttttttcctgattgtatagaaacaaatgtacaaaactcatctgaagctaggtttggcactgaattttcaccatgaggtttgtggcactgtgtgtcacagggaagtagctcaggggttgtgagggagcttttatttctaaagggcagtagtaatttatagacaaaaacaatttttcaaggcctctttattaccactgcacagctatcatgtgtaaaatttcaagcattatattgcataagttctctttagcctattaaatttaatatgtccttgcaaaagggattttgtgtaaaaagtgtcagtgttagtgactcatctgcaagaatctacaaatggagctatacaactatgaatacataaatacagcatggttcctagttattagagaaacattttctttatattgaggtctacgcacttcttgactttccattttgtctgtaattataaaacagcaaataacaaagaagcattgggaccccctcggctgccttgataataaaatcaagcttccttcatgggactaagcatgtgtccttcaggatacttacctctaagcactcagcaggggttactacaaagcgttttgtgtggttttcaaaaaacagtgtattttgcaagaggtgctttgtaattttaattatttcactgattttctgacctcataggaagtctgtgcctgttgaggccttcaattttgtagcttttctgattttttttcttctttttgtgattttgttgttgttttcattttgatctaaaggagaagtgtgaccccggagtggcatggtcaatccagggcaccctttctgtaagacaactcaaaggaaaagaagccttttcaaaggtaatatcgagccattgcactctctcttaaggtgccaggtatgggagaatgacagatgccttatggaaatggtctacaaaacttttcttcttctaagtaataaaacacatagcatgattctctctccctctctctctctctctctgcccaccccctgctagtttccaggagaatacttctctaaaattcatttttttctattttggaataaattatctttatacagtaattcaaacactgatttccattaacctttggccctgagttttcttctaacatagaagagttcattttgagaggcactcagttaccattcaatctgtgctgtaagtatgggactttgtacaaatgccctttttgagggccaaaaatttcaatacactttgttctactttgtgaaccaggtctggatctgcacagagaaagtaatgctgagctgtccaaagagtccgctcaggtctccctcctaaccctcctctgccttcccctagtttgcttatcctcacgtctgacactgaggagtgcatagtcttcaactgaaatggcactacagttagttctcattggaaacaaacaagtgtatttctggaacctgctcgtctaaaatagtcaatgcctttgtaaagactcagcatattcaatatctattgtatggtagctagctatatacatagattgactatttttagtcctggtttgtgtattgttgagctatagtagtttgctttatccatttgtgggattaaacaatactgtttaatggttgtaaacttttataaaatctctttgggttttttgtttgacccaaacataatgtaagtcttaatgacaaaatacacaaagttaaccagaggtgagtgaaaatatagcccttccccagttttgtctgcccctataatgcacgtgcattgctttgtaatatgctctcgctagcatgaatgtgctatgactacttcatgaggttttgtttcacctataattgtgatggaaaatgctgtattgctgacaacaatgaactgtaaccacagttatttactgcataaactatttgtgtactaacca

SEQ ID NO: 8671 - DNA, 7255 bp, Homo sapiens
catgtggattccaagcaggctaaaaagaaaaagaactgattagacctcagacgacccactaaacgggatgacggccacagctgaggtagagacaccaaaaatggagaagagtgcctccaaggaagagaagcagcagcctaagcaggacagcacagagcagggcaatgctgattctgaagagtggatgagctctgagagtgaccctgaacagataagccttaagagtagcgacaacagcaagagctgccaacctagggatggtcagttgaagaaaaaggagatgcactccaagccacaccgccagctctgtcgatcaccctgcctagatcgtccaagtttctcccagagcagcattttacaggatggtaaacttgacttggagaaggaataccaagctaagatggagtttgcgctaaagctgggctatgcagaggaacagattcaatcagtgctaaacaagctgggcccagaatcacttattaatgatgtattggcagagcttgtcagacttgggaacaaaggtgattcagaagggcagatcaacttgagtctgttagtgcctcgtgggcccagctccagagagattgcaagccctgaattgtctcttgaagatgaaatagataacagtgacaatttgaggccagttgtcattgatggaagtaatgtggcaatgagccatgggaataaagaagaattctcctgcagaggaatacaacttgctgtggattggtttctagataaaggccataaagatattactgtatttgtgcctgcatggagaaaggagcaatcccgccctgatgcaccaattacagatcaagatattctacgaaaactggagaaggaaaagattcttgtcttcacaccatcccgaagagtccaaggcaggagggttgtctgctatgatgaccggttcatagtcaaactggcttttgattctgatggcatcattgtgtccaatgataactaccgagaccttcaagttgaaaagccagaatggaagaagtttatagaggagcggttgctgatgtattcttttgtgaatgacaaatttatgcctccagatgatccattaggacgccacggcccaagccttgaaaatttcttaagaaagagacccattgttcctgagcataagaagcaaccatgtccttatggcaaaaaatgcacctacggccacaagtgcaaatactaccatccggagcgggccaaccaaccccagcgttcggtggctgatgagctccgcatcagtgccaaactgtccacagtgaaaactatgagtgaaggcaccctggccaagtgtggcacagggatgtctagtgccaaaggtgagataacctcagaggtcaaacgtgtggcccccaagcgccaatcagatcccagcatccggtctgtggctatggagcctgaggaatggctgtccattgcccgtaagcctgaggctagttctgtcccctcgcttgtgactgccctaagtgttcccacaatcccaccccccaaaagccatgcagtgggtgcactcaacacccgttcggccagcagcccagtgccaggatcctcccatttcccccaccagaaggcctctttggagcatatggccagcatgcagtatcctcccatcttggttaccaacagccatgggacccctattagctatgctgagcaatacccaaagtttgaatccatgggggaccatggctactattcaatgttaggtgacttctccaaactgaacatcaacagcatgcataaccgagagtattacatggctgaagtagaccggggggtgtatgcccggaatcctaacctctgttctgacagccgtgtgagccataccaggaatgacaactattcctcttacaacaacgtgtatttggctgtagctgatacccatcctgaaggcaatttgaagctgcaccgctcagcatcccagaaccgacttcagccttttcctcatggttaccatgaagccttaacacgagtgcagagctatggcccagaggattctaagcaaggcccccacaaacagtcagtcccccacttagctctgcatgcccagcacccatcaactggaacacgttccagctgtcctgcagactaccccatgcctcccaatatccatcctggggcaaccccccagccaggccgtgccctggtgatgactcggatggatagcatttccgactcccgcctctatgagagcaaccccgtgaggcaaagacgacctcccctgtgccgggaacagcatgccagctgggacccgctgccctgtacaactgactcctatggctaccactcctatcccttgagtaacagcctcatgcaaccatgttatgagccagtcatggtacggagcgtgcctgaaaagatggagcagctttggaggaatccttgggttggaatgtgcaatgattccagggagcatatgatcccagaacaccagtatcagacctacaagaacctctgcaatattttcccttctaacatcgtccttgcagtgatggagaagaatccccacacagcagatgcccagcaactggcagccttgattgttgctaagcttagggctgcacgttgatatgacatagtacttatttctttatacaaatatgaatattaatactaataatacactaatacaataattatagtaactaataatttgtgttgcgctttacaagttagagtgtttatatcatttaagcgcttaacaaccctgtgaggtacgtcttactaacatcctcttttatagagaaggaaggtgaaggtcagtgaaattaagtggctagccagggtcacactgctagcaaatgactaagtcaagacacacacccaagtcctctaaatccaagtcccatgcccctttgcactgcaccatgcaggtaatggaggacaaaacccagggggagaggtctagatgtaagaaatcccagaggattccattaccagagttttcctttttctcttttcgtttctttctttctttctttattttttttttttgagacagaatctcactctgttacacaggctggagtgcagtggcactatctctgctcactgcaacctccacctccagggttcaagtgattctatggcctcagcctcccaggtagctgggattacaggcgtgcaccaccatgcccagctaatttttgtatttttagtagagacgtggtttcaccgtgttggccaggctggtctcaaactcctggcctcaagtgatccgcccaccttggcctcctaaagtgctgggattacaggtgtgagccactgcgcccagcctaccagagttttcgtagtcacatattctatattacaaagtatggatgatatatccaatttagagagcaaaagcatcaggatcagatcatatgttgaattaaccttttaggttttttctaatagaaatatttaaagctatttaaaagtaaatgcatactttattgcatggatatctgatcactcaatctatattaatgaaactatagggtcacattgaagcttctagaactatattttaaagctattattagcaattatattgcatgtatgaatatatatatttggtttgagatgtgtgtgtatctctgtataaccttttatatagtgataatgagagggtaggctctacacagtccttcgtctatagctgtataggtcactaatctgacttgatgattttaagtcacatttcatagttttaactagttatgagagagaaattatatggcaatatttgaacattgctttcttaggcaccagagcaaagcaactctgtttcctttgcacattttacctgccaacatttattaacagttcttaccttccaagtctcttcaccttagcaaattagggatcaggttgcagtcttctgcagagaaactgatggttaagctcaagttccaagcatagtatgtgtgtgctacacaagctcagaagagtttgacaaggaccaggggacttactaccacaatccacttcccttatcccaggagagatggccaaacccatgtggcattaaatggtgaataaaaaagcttcactcaaggagggactattggatgctctttggacttctgacctatgcagtattcaacatcattggatgaaatgtaatggaggacagtgcacagccatgtatccactttctcttcctgtccaccctttgggtaataaggtcaatcattggtggaacagaatttctctaggaaacaaaaccaggggattttatttgtggaaaaaggaagtttccaaaaggggatactgcatctttactaatagctggctcagttactcactttaaatccatgcaaagagtgcacttgctgttaaataattgttaaatgagttattagaaggcaggacttttggtttgggcgacaccatttgcgcaacttgtatcttgctcagggtggaaaacttcatagctaaatgcctctagaagaggtgtttattgttttttttaagctgcactaaatgaattccctttttgaatccattgtatatttcaatatttcgaaccatgatcagctcactatttcctgagctggaacttgctaacttctatgatcgttttttcatgaaagttgagaaggccgggccttggccttttgtttcttcatgagaaggtgtgacactgcctataaatgtttcttactgtgaaacactctgaatgtgaggctgtagtcagggttgtttctggtggtttgacaatggcttgcatgctgctttctggctttctgtctctgtccaagttgatcaatactgcatcttaaccaatgtttcacttgagttaaccacagctttacattctatctcctatcttctgatcttcgtataccccagcatattgaaaaagagtaaaagtattttctatcaatcaggtagatccacagagtgacagttgccactgcagtgcttgctatttcacacaaacaccatttcataccttcaacttcttggactttctaaatcggactcgtgtctaaatcagggtatttgacaatctcagatgatgctactgcctatgtgccagttagttcatcttcctaccaagatcatgaatggcaccacactatccactagctgtacaatttacagagaagcacaagattcatcttgtcacctacaattcgtcttgaacatgttcatatttagtactcagaaactgtgtaagctcctcccaatacagaaaatattttttaaggcagcatatgtatttctgatttactaaaaacgattgtcattctcctctcattcttctttttggtatgaaccaaaagcggctaggagcaatgcctcaaataaccagaaatgaccttttgttgatacaaattgtatctctttttttcctgattgtatagaaacaaatgtacaaaactcatctgaagctaggtttggcactgaattttcaccatgaggtttgtggcactgtgtgtcacagggaagtagctcaggggttgtgagggagcttttatttctaaagggcagtagtaatttatagacaaaaacaatttttcaaggcctctttattaccactgcacagctatcatgtgtaaaatttcaagcattatattgcataagttctctttagcctattaaatttaatatgtccttgcaaaagggattttgtgtaaaaagtgtcagtgttagtgactcatctgcaagaatctacaaatggagctatacaactatgaatacataaatacagcatggttcctagttattagagaaacattttctttatattgaggtctacgcacttcttgactttccattttgtctgtaattataaaacagcaaataacaaagaagcattgggaccccctcggctgccttgataataaaatcaagcttccttcatgggactaagcatgtgtccttcaggatacttacctctaagcactcagcaggggttactacaaagcgttttgtgtggttttcaaaaaacagtgtattttgcaagaggtgctttgtaattttaattatttcactgattttctgacctcataggaagtctgtgcctgttgaggccttcaattttgtagcttttctgattttttttcttctttttgtgattttgttgttgttttcattttgatctaaaggagaagtgtgaccccggagtggcatggtcaatccagggcaccctttctgtaagacaactcaaaggaaaagaagccttttcaaaggtaatatcgagccattgcactctctcttaaggtgccaggtatgggagaatgacagatgccttatggaaatggtctacaaaacttttcttcttctaagtaataaaacacatagcatgattctctctccctctctctctctctctctgcccaccccctgctagtttccaggagaatacttctctaaaattcatttttttctattttggaataaattatctttatacagtaattcaaacactgatttccattaacctttggccctgagttttcttctaacatagaagagttcattttgagaggcactcagttaccattcaatctgtgctgtaagtatgggactttgtacaaatgccctttttgagggccaaaaatttcaatacactttgttctactttgtgaaccaggtctggatctgcacagagaaagtaatgctgagctgtccaaagagtccgctcaggtctccctcctaaccctcctctgccttcccctagtttgcttatcctcacgtctgacactgaggagtgcatagtcttcaactgaaatggcactacagttagttctcattggaaacaaacaagtgtatttctggaacctgctcgtctaaaatagtcaatgcctttgtaaagactcagcatattcaatatctattgtatggtagctagctatatacatagattgactatttttagtcctggtttgtgtattgttgagctatagtagtttgctttatccatttgtgggattaaacaatactgtttaatggttgtaaacttttataaaatctctttgggttttttgtttgacccaaacataatgtaagtcttaatgacaaaatacacaaagttaaccagaggtgagtgaaaatatagcccttccccagttttgtctgcccctataatgcacgtgcattgctttgtaatatgctctcgctagcatgaatgtgctatgactacttcatgaggttttgtttcacctataattgtgatggaaaatgctgtattgctgacaacaatgaactgtaaccacagttatttactgcataaactatttgtgtactaacc

SEQ ID NO: 8672 - DNA, 8807 bp, Homo sapiens
gcttctccgcgggccccgccgcccgctcgccgctttctcgcggggctggctatgccgggtggcggctcccaggaatacggggtgctttgcattcaggaatacagaaaaaacagcaaagtggagtcaagtacacgtaacaacttcatgggcttgaaggatcacctagggcatgacctcggccacctttatgtggagagcactgacccacagttaagtccagctgtaccttggtcaacagtagaaaacccaagtatggataccgttaatgtggggaaggatgaaaaagaggcgtctgaagagaatgcaagctctggtgactctgaagaaaacacaaattctgatcatgagtcagaacaattgggtagcatttcagtagagccaggcttgataactaagactcacagacagctctgcaggtctccctgtttagagcctcacatactcaagcgcaatgaaattttgcaagactttaaacctgaagagtcccagactacatccaaggaagcaaagaaaccacctgatgtggtgcgagaataccaaacaaaactggagtttgcacttaagttaggttattctgaagaacaggttcagcttgtactaaacaaacttggtactgatgctttaatcaatgatattttgggagaacttgtcaaacttggaaataaaagtgaggctgatcaaacggttagtacaattaacactataacacgggaaacttcttccctggaatctcagaggtctgaatctccaatgcaagagattgtaacagatgatggtgaaaatctgagaccaatagttattgatggcagcaatgtggcaatgagccatggaaacaaagaagtattttcctgcagaggaataaaattggcagtggattggtttttggaaagaggccacaaagacattacagtttttgttcctgcttggaggaaagagcaatcccgacctgatgctctcattacagatcaggaaattttacgtaaattagagaaggagaaaatcctggtgttcacgccatcccggcgagtccaggggaggagagtggtgtgctatgacgacaggttcatcgtgaagctggcttttgagtcggacggtatcattgtgtccaatgataactacagggacttggctaatgagaagccagaatggaagaagttcatagatgaacgattattaatgtattcatttgtcaatgacaagttcatgccccctgatgaccctcttggcagacatggccccagtctggataattttctgaggaagaaacctattgttcctgaacacaaaaagcagccttgtccatatggaaagaagtgtacctatggacacaagtgcaaatattaccatcccgaaaggggcagtcagccacagcggtcagtggctgatgaactccgtgccatgtctagaaatacggcagccaaaactgcaaacgaaggaggactggtgaaaagcaacagtgttccttgtagcaccaaggctgatagcacttctgatgtcaaacgaggtgctccaaagaggcaatcagatccaagcataaggacacaagtctaccaagacctagaagaaaagcttcccaccaaaaacaaattggaaaccaggtctgtaccttccttagttagcatcccagctacttctactgcaaaaccccaaagcactacatctttaagcaatggccttccatctggagttcatttcccacctcaggatcaaagaccacagggacaatatccttcaatgatgatggcaaccaaaaatcatggaacgccaatgccttatgaacagtatccaaaatgtgactcacctgtcgacatcggatattattccatgttgaatgcatactcaaatctgagtctctcaggcccacgaagccctgaaaggcgtttctccttagacacagattatagaataagttccgtagcttctgactgcagcagtgaagggagcatgagctgtgggagcagtgactcctacgtgggttacaatgaccggtcctatgtcagctcccccgacccacagctagaggagaatttgaagtgtcaacacatgcaccctcacagccgccttaatcctcaaccgttcctgcagaatttccacgaccccttaaccagagggcaaagttacagtcacgaagaaccaaagttccatcacaagcctcctcttccgcacctggctctgcacctgccgcactccgctgtgggcgcccggtccagctgtcctggcgactacccctctcctccaagttcagcacactctaaggcaccacacctagggaggtccttggtggccacgagaatagacagcatctctgactctcgactttatgacagttctccttcacgacaaagaaagccttattcccgccaggaaggcctgggaagctgggagaggccaggctatgggatcgacgcctatgggtaccggcagacttattccttgcccgataactccacacagccgtgttatgagcagttcaccttccagagcctccctgagcaacaggagccagcctggcggatcccatactgtggaatgccgcaagatcccccgaggtatcaagacaaccgagaaaagatttatatcaatttgtgcaacatcttcccccctgaccttgtgagaattgtcatgaaaaggaatcctcacatgacagacgcccagcagctcgccgcagccattttagtggagaaatcccagctgggttattgaaagatgatgcatctttgtggtgtttagtagttttttgttcagctcaaatgctgagggaggtttgctacaatagcacatgtgatctccttctcagcaaggaggttatatagtatccatttatgtgaaatactgtatcatggaatctgtatgtatagccccacatggtggaagtatcacgggattgctttacatttaaactttttttttttaacatttcctttttaaagctatatccttggctggaaatttttccagtttgatttaatagatgtatctgtgatctttgatattaatctttggtgcatcaggggtttatatgcagcactttttatccttgttttgtgttttattaacttggtgtttgtctatcaattgcaagcaattacaataccttcagaatgtgggacatttgactagacctagcaaactgttttttcgagccaagcttagttagactcttttacagctttttaagttatttttatttggggaaagtgggcttctttgtgctataatcattatttatagaaacaaagttatactacagcactgactttatattttaaacagaatgtaagttaccagttttatgttgaaatgtgttacagtatatatatattagaatgatttacaatatggcacttttcgatgtgttatttttgtttggatttttttttctgttaagaaattagttaatttaatatggtcaatttaaaagaaagcagatgcaatcaatggaaaaatgtttccattttttaaaaatgaataaggcaaaagctgtaactgttacaggttagagctttgttatccagctatgatgtgcttcttgacagtagaagtggaattgaattcctagatttccattaacctgtatttttaatatgtctgtctttttgttttggggcacaacaatactggataaaataaccctttcacagcacttgcctgtttttaatgaatctaattattcacaatgcaacttttatatttaacatactctttagctttcctgctatttatcaaggctggcctgaggtgggtttatgtgttgaggttatgcaacatttcttgatactgcactatagagaaatggtgatggaggagttgtaaatggtaacttaaaatttttgtaagatattgtatattttccattttcctgaaggtagttttcttgggggggcctgttatattattaaggccagactcttgccacaaatagtgtagttttagatacagactaaggtctgttctagtattagtaagggatatttctggtttcaaagtcatgggttttgctagtggtgaatacatttctgcggagtagaagatagattttgcagtcagtggcagacagttgtgtgattgacatcacttgactgttgcgtccaggttttgaattgtacttcacgtaacagatgcattcagatctttttctgtagtctgcttagatgccctggctattctgattatcctacatgctacagtttgaagtgaagccctgaaaaaccagaaagtaccttttactgttgatacaaattgtatctttttaactataagaactattttgatttgtagatctagttaaaacacaagtatgtaactatgattagacttttgggcaacattttatcccttatttaaatacaaatttttaaagtaaaattgaggtctagaatagattagaaaataaaaataacaatttagataaatagaaatgtctgtcttagttttatataatatattaaaacacagtaaataaatttattggcattttctttctcctaaaacttacctagtgtgaacttaaaataaaggtaaaatgctgcctgaaaataatgtccaagcacctttgactaggataacattttcactacttgtgtgacactgtgtgttgcacgaagtaggatttgggtatacagtaaatgcttctaaaaggcattgtgcatattgacataaccaataatctgaaccgtgttcagcaaacttaattcaggaaagtggtattctacacaattattgctgttgtgtttgaaatgagtgtggcactcatctgtatccagaaataatatgggtgaggccacacaacccattctgagtggtgtctgtctgaaagcaaccctactcgcatgtgaaattgttctccttgatttggtcactataaagcaagtttaaatgtagaggctaactcagtgccaaaaacagggttacaaatgtgtagtatcttttattttagtcatattctaagacttctttttagtatgaaatcacttttaaattatacatgtaggttttgcttccattttcttcattttaccattttaattatttgaacattcgccaaattttacatttatttaaatgagatcttaggtgagatgtgtgtgacactttgaatttgaccttcttgtgttattagctgactatttgtcattgcctcatggattttaaattatgggaaaatagtgtagccagctgccacctctactgaagtgagtagctctgaactacccacactaaatccttcagtgtaattaattatgagtttaaaaatagcagttttcttatgtgaagaggacagtttgtcccctttttttgaagcaccgatgttgcgttcagagctgtagaatgagataattggcagactttaggtacagcaaattcttacttatctaaagcaataagtcaaaggagtccatcattaaattaaatccatagctgatcacaagccttcattttagccaaaactttctctctaaccaaatcttttaccagacttgctaataaataaccagagagatgtgttaataagtgaagttgccagaaatggtcaactgatcggaaaaaaaaggattcagactggagtattttgcccctgaataattgacagttgactgtgctttacacagtaactagccagtctgttgtctctgtgtcttagtccagagggaatagtacccaattggccaaatactggcccttagtatctcctcctttcttgcatgggatacagacgttttcagtcttgtttttatgatctctctctatatcctgataagagtttgtcattgacttacacatttggaagaaatgcacaccagtgtaatatatttgatactggtggaaacttgaactttgtgtttttatgaaaattcatttatgagaatatgtaatataactgaagagtattttatgtatatctatatacacaaatatgtatttgttatgaggtattaaaaacaggggttggggggagtgcttctgatggctaacttttctctaattaaactatgtttctttgagttgtgaacgaccgagtctggggtctggacggccaatgataagatttagaaccacttggatggaaagcagttcttcactggttttattcttggtattttcaaagaattattttgatatttttaatagaatgtgtaattttaaaatacacaaaaaacttaaagtagtattgattatacaaataattatttaacatgtcttatggatgtatctatatgtatatagacagtaatatatttataaaacaaatatactttgcttatgttatagctcttagtttgtgacaggtgggaggatggctctgggtgtgtgtgtgtgtgtgtgtgtgtgtgtgtgtgtgtgtgtgttttgaaaactctcaagctgttttccctctgatttacaatggtatttactttaaagtatgtttggttttcattattctttttgctctccaacttccttattcaagataaaataagacatacagttttctggccattctgttggtgtgtggtgcacccattttattgtcatctaactcctggagaattcccacgtgacctgaaatcaaacagattctggctggacatatgcttatgttccaaatatattaaagatgttaattcagctaacagttaagtttccaaggtatacaccaacaaataaaatgaggtattaaaaagagatggattacacacatgcattagaataagagaaaacagtagtgttaataaaagtaaagaaacatacactatcttagccccctagggcaggggttgactttttctgtaaaggatcagatagtaaataatacaggaatcatatggacttcaaatgccattgtaaaaactactcagctctgcctttagagcataagaacagccacagataacatgtaaattagtgtggctgtgttccaataaaactttatttacagaaacgggaagccggtcagattgggcctgtgggccataatttgctgatctcaagcagtaaatcctggtatatgttaatagaagaaatcataattgcatttcagttgacattaaaagaaaatctggtagtttttgatgtccttcaaaagaggattgttagacattgatgttaaagcatcttaattcatttgagttttcttacctgtttacacccattatttattagagatatttcttgtgtttaaccacaaaaaaaagcactctgttaaaatgttttaatatgtattgaatttctttcataaacttttcatttctgttgataaatgggaatcccttaccaaccttttgttttttaaaagtctcatagaccaaaaaaaatctgttgcagcatttaattagccacagatacattttggctgcatttaccagttacatttttccattggttttggcttctaataaataacatatctgccattctttaaaaatgattttaaagaagataaatatattgtaatttcacatgctatagctttattctgtaagattaaaaattgtgactagtataattgtagctataatgtgagtggcatgttacaatgtaactctttatgagaaataaaatgtatctctgctttgtctgtccagatctttaggatttttagatgccttgggactgtccttggtgaatgatattcttcatatgatcatatgtaattttgaattcgttggaagtacacgctgctgagcatgtttattcacagtgctttataccgggtgttgcatcagtaatcattttcataagaacatttaaacagcatgaacatcatcatccacttaaatagttaaactttcttttaaaattggaatgcaactgtaggttttaacaatgtttattgttttttaagtggttactttgtttttccttaatactttctgttaacttaattattactcctgttgcagtgttactgttatgtattagaagtggcttttccccctaagatccttagtcttttaaagacaatttaaggtattggccatttggcagtagaaaatgtgcatgttttaacttggttttataaaatctgtaatgtttcacttcttgaaccatgtaccaaatttgccaattttctgtccaagtgtttcagatgaataacaaaacgctgttcattgaagctttcgccacctttcttaaagcagcgtatgttccaagggaaaaaggcattgaaaagcaatcgtttgtttttatgaagaataggtgttcagattccttcagtttttttgaaattagaaatttcttaccttatgtgaaatattcacaaacgtgcacacttctgcagagacaaagcatttcactgcacgtgtaccaggttattgattttatcttttcctttcagggttttgtcctcccaaaccagagtcatatgctgctagtagaattttttatttgatcctgcgaacttttcttataggaaaagtaaggcaaaggatgtgtagtgcaaccatctgataaactagtgtgattgtatttatcctctgttctgtgtatttctgtaatggaatctttacaattcccaaaacggtattttagacctactggaaatctgtatcgaaacagctatgtgattctgccactgagaaaaaaaaaatttttaattcgtttttcttatgctggtttgtttttctttaatgaagaaattgatctcatatggcatcatagatgctaaataaataaaagcatcatacttctctagtttgcctgcattcagtggctaacattatgagcattgtgtaagataaacacatggtcagtatcaatgtaaatgttagagccatgattaattcctatgaaaattgaaattaaatgtcaaagacaactagacataa

SEQ ID NO: 8673 - DNA, 8018 bp, Homo sapiens
aaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccatgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagaaacaaataaatccgagagaactgagagtctggaaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctggccacagaatttgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtggataatattgttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgttgtctttcagtttgaaatctttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 8674 - DNA, 6409 bp, Homo sapiens
agaggaacagggcaaacctctgacttccggcggcattttgaggcggtcctcctagcggcctgtagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccatgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagaaacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaaggtagtttcattttactttaactatataatgtctgttaaccatttaagatgccatctgaaggggattctgatctgttcttatgtagcacttaacactgtgtagaaactattttttgagaaatcattttataatcattatttaaccctcatggtcaaagtttctctttaaaatttattttgagaagaagagttatcccacagaaaagttgggaaaagagtacaatgacctttttgtatgaaaattacttattaacaggccaggcgtggtgttgcatgtctgtagtcacagctactcagggaggttgaggcagcaggattgctggagcccaggaaattgaggctgcagtgagccatgattgagccaccacactccaacctaggtgacagagcaagaccctgtctcaaaaaaaaaaaaacaaattaaccaataagttctaatatcaaagtgctcagtggtttgcccttggctaaatgaagcagagccaggaaaaacagactacatatttttcatgtctaaagaaattgggtattttggcagccctttcccctagacatctacccaaatgcaggtgtgtaggttgagtctttaacaaagtgattaagagcttggtctgtaaggccggatgatctggatttcagtaggcacaccacttactggctattacttaatctgtgtgttagtgtcatcatctgtaagtcaggaataatcataccaccaacttcctatggtaattaggagcaaatgagttattacaggcaaaacacttagaacagttcctggcatatagtaatacccaataaatattaactgctactttgaaaatatcctatcacgctgatttttgacctcactgcagcaattttcagttattccagattatctagcttatggattctggtggtaggggttgtttggttttggttttcactgtctctgtctcatctagtacctaccttagtttattttgcaacttactaatactttattaatggggagggacgagtagatggtaaaaagaaggaaaaggaggtaaaaggtgaaaggaacaacattaattaacaattttacgtcatgtccctggacataaaagtttagttagtattaaatttttcactaatacaaaataaaaaaatattgttttatgagttttatgaattcatgcccttcctttactctattagcataagcagtaaatttttttattttaatatagcccaataaacctagagtatacatgtacaaaatacatataattgttaacgtgtattaaccgaaaaatgacccaagacttagttcttgccctactgtatctgccttgtttggttggttctgtgaccttaagcaaataactcctgtgagcctcaattttatttgtaaagtgatggaataaaacccctaaaatcttacccacctctaaagatatttgtttctgtgaccttttgctagtagcatttcaagttaaaatctggtttgattttgctacccatgaaatacagttcggcccttacttattgatgacttaacctaaacagtgaaaatatgcactgtaaagggtggggtgatgtggcttaacaatcagacttcttctatttttgctgctatggtggttgtattagagaactgatgtattatcttgaataaagactttgtcttgtttactgcc

SEQ ID NO: 8675 - DNA, 4794 bp, Homo sapiens
gaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagaaacaaataaatccgagagaactgagagtctggaaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctggccacagaatttgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtggataatattgttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgttgtctttcagtttgaaatctttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcatt

SEQ ID NO: 8676 - DNA, 695 bp, Homo sapiens
ttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaacagtgataacgatttaggtcctgggaattgagtgctactttatcttcacaagccttagtagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttagggtaggat

SEQ ID NO: 8677 - DNA, 2075 bp, Homo sapiens
agaggaacagggcaaacctctgacttccggcggcattttgaggcggtcctcctagcggcctgtagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccatgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagaaaagagaaaaag

SEQ ID NO: 8678 - DNA, 6114 bp, Homo sapiens
ctccgactctcggcacctggcctccagctttcggaactatggaggccgcgcccgggacccccccgccgccgccatcagagtcgccgccgccgccatcgccgccgccgccatcaacgccttcgcctcctccgtgttcccccgacgcccgcccggccaccccgcacctcctccaccaccgcctcccgctccctgacgacagggaagatggagagttggaagaaggtgaattggaagatgatggggcagaggagacccaggatacctccggagggcctgagagaagccggaaagaaaagggggagaagcatcacagtgattcggatgaggagaagtcccacaggagactgaagcggaaacggaagaaagagcgggagaaagagaaaaggaggtcgaagaagaggaggaaatccaagcacaaacgccatgcttcttctagcgatgacttctctgacttctcagatgactcggatttcagccccagtgagaaaggtcaccgcaagtacagagagtacagccccccatatgcgccgtcccaccagcagtaccccccatcgcatgccacgcccctgcccaagaaggcatactccaagatggacagcaagagttatggcatgtacgaggactacgagaatgagcagtatggggaatatgagggcgacgaggaggaggacatgggcaaggaggactatgacgacttcaccaaagagctgaaccagtaccggcgtgccaaggagggcagcagccgcggccgaggcagccgaggccggggccggggctacaggggccgaggaagccgtggaggatcgcgaggccgcggcatgggcaggggcagccgaggcaggggcagaggctctatgggaggagaccacccggaggatgaagaggatttctacgaggaagagatggactatggagagagtgaggagccaatgggagacgacgactatgacgagtactccaaggagctgaaccagtaccgccgctccaaggacagccgaggccgagggctaagtcgaggccgtggcaggggctcccgaggtcgagggaaaggaatgggtcggggccgaggccgaggtggcagccgaggagggatgaacaagggcggaatgaacgatgacgaagacttctatgacgaggacatgggcgacggtggtggtggaagctaccggagtcgtgaccatgacaagccccaccagcagtcggacaagaaaggcaaagtcatttgcaagtacttcgtggaagggcgctgcacctggggagaccactgtaattttagccatgacatcgaactcccaaagaagcgagaactgtgcaagttttacatcactggattttgcgccagagctgagaactgcccttatatgcacggtgatttcccgtgtaagctgtaccacaccactgggaactgcatcaatggtgacgactgcatgttttcccacgaccctctgaccgaagagacgagggagctcttggataagatgttggccgatgatgcagaagcaggtgccgaggatgagaaggaggtggaggaactgaagaagcagggcatcaaccccctgcccaaaccgccccctggtgtgggcctcctgcccacccctcctcggccccctggcccgcaggctccaacctctcccaacggcaggcccatgcagggtggccccccgcccccgccccctccccctcccccaccgcccgggccccctcagatgcccatgccggtgcatgagccactgtccccgcagcagctgcagcagcaggacatgtacaacaagaagatcccctccttgtttgagatcgtggtgcggcccacgggacagctggctgagaagctgggtgtgaggttccctggacccggtggacccccagggccaatgggccctgggcccaacatgggacccccagggccaatgggcggtccaatgcatcctgacatgcaccccgacatgcacccggacatgcaccctgacatgcacgcagacatgcacgcagacatgccgatgggccctggcatgaatcctggcccacccatgggccctggcggccctccaatgatgccctacggccctggagactccccacattctggaatgatgccccctatcccgccagcccagaacttctatgaaaacttctaccagcagcaggagggcatggagatggagcccggactcctgggggatgcagaggactacgggcactacgaagagctgccaggggagcctggggagcacctcttccctgagcaccctctggagcccgacagcttctctgagggagggcccccaggccggccgaagccaggcgccggtgtccctgacttcctgccctcagcccagagggccctgtacctgaggatccagcagaagcagcaggaggaggaggagagagcgaggaggctggctgagagcagcaagcaggaccgggagaatgaggaaggtgacaccggaaactggtactcaagtgatgaggatgagggtggaagcagtgtcacctccatcctgaagaccttgaggcagcagacgtccagccgacccccggcttcagttggggagctgagcagcagtgggctgggggacccccgcctccagaagggacaccccacaggaagccggctggctgaccctcgcctcagccgggaccccagactcacccgccatgtggaggcttctggcgggtctggcccaggtgattcgggaccctccgatcctcggctggctcgcgccctgcccacctccaagcccgaaggcagccttcattccagccctgtgggccccagcagttccaaggggtctgggccgcccccaacggaggaggaggaaggggagcgggccctgcgggagaaggccgtgaacattcccctggacccactccccgggcaccctctgcgggacccacggtcacagctgcagcagttcagccacatcaagaaggacgtgaccctgagcaagcccagcttcgcccgcaccgtgctctggaatcccgaggacctgatccccctacccatccccaagcaggacgcagtgccccccgtgcccgcggccctgcaatccatgcccaccctggacccccggctgcaccgcgctgccacggcagggccccccaacgcccggcagcgcccgggcgcctccacggattccagcacacagggcgccaacctccccgactttgaacttctgtctcgcatcctcaagacagtcaatgccaccggctcctcggccgcccccggttccagcgacaaacccagtgacccccgggtgcggaaggcccccaccgaccctcggctgcagaaacccacagactctacggcctcctcccgggctgccaagcccggccctgctgaggcgccctctcccaccgccagcccgagtggggatgcctccccaccagccaccgctccctacgacccccgcgtgctggcggccggtggactgggccagggcggagggggcgggcagagcagtgtgctgagcggtatcagcctctacgacccgaggactcccaacgcggggggcaaagccacagagccggctgctgacacgggtgcccagcccaagggtgctgagggcaatggcaagagctcggcctccaaggctaaggagcccccgttcgtccgcaagtctgccctggaacagccagagacagggaaggccggtgctgatgggggcacccccacggacagatacaacagctacaaccggccccggcccaaggctgctgcagcccccgctgccaccaccgccaccccaccccccgagggtgccccaccccagcccggggtgcacaacctgcccgtgcccaccctcttcgggacggtgaagcagacacccaagacgggctcaggaagcccatttgctgggaacagtccggcccgcgagggtgagcaggatgcggcatccctgaaggatgtttttaaaggcttcgaccccacggcctcccccttttgccagtagtgtccagccagagctgcggctccagccacccttcctagggtggcattcagggcagcacccagggtagggaacttgggggcaaggggaggcaggctgggtgttccttttttcttttctttttcttttgctttccgtctcttttatttttttttaaagtagtactttctttgagatttgtaaattgtatataaccatcttaagttctggtcagtgtggcgggctcaggggctcctgctgagcaaaccgactcatgcccgcaaacctgtgaactttcgccagtgcctggcctcagactctgtgggctctgcgtggccgggccttgctggaggcccagtgggttttctgggcaaagcatggccccttttccccaggacaaagggaacagttggtgtctgggaaggtattgaacgctcctcaccctgtgcccgaagagacccggaaccaagaccatggcagggcctgcgtggaagcaggtccaggcgtttctagaaccctagggtgcaccatcactgtcttttcagtgcaggctgtaacaacccactcaggagacagtgagagtgaaaaggtattaaggaaaaagcccccagcggcactatgggggctccctggcgcatgcctgctcctgtccctggattaccacacgtgccctccctgccaccctccgtctagagcaagcggatgccccccagcctgcagcagaagcctccacagtgagaactggacccaaaggtagtgggggccggtgtggggcagagtcctgaagagccacctctaggaggcagcccctaggagcacgcacgttctgtcagtattaccccacctgtcctatcaggtgggccacaccctgcttgcccacaccagggtctgtcctggtcctcaagccacgcacccgctatgcctgcactgcagcccagccccggacagctccaggatccgtgcagtggctgcgccgccaggccccaacaatggggaccctggggtggctcctggccaagtgttctctgttttcctcgcacctccttacactgtgtgacctgcagggcatgaggtattgatgtgttcgggtttcctttcccaagccagcagatgcaggtgttccaaggtgtgttgctctgtgggatttgtggacacttaagaaacggactgagtgggaaccctgcagccaggggatggggagcctctgctccccccatgctcccaccctggctgagggccagcctcatctgcagagccctggaggaggcccacctatggacacagcccgagagatgggcgcaaggggtgctgggggaggcctgctatcctgcctctgggccacttgaggggcctcaggaagtgtgtgcttgtggctgcatctgcccgtctccctggcccaccatgtggctgcaggccaagctcttcattgctgaccatgaagagacctagttacctgccaagggattccccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtctttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttatttt

SEQ ID NO: 8679 - DNA, 11539 bp, Homo sapiens
ttttctcgagccgcctgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgagaaacataagcataattccccatctagtgatgatagttcggactacagccttgattcagatgttgaacatacagaaagttcccataaaaaaagaactggtttctacagggattatgacattccatttactcagcgtggacatatatcaggaagctacataacatcaaagaagggtcaacataacaaaaaatttaaaagtaaagaatatgatgagtacagcacctacagtgatgacaacttcggtaactacagtgatgacaactttggtaactacggtcaggaaacagaggaagattttgccaatcagctgaaacaatacaggcaagctaaagaaacctcaaatattgctttagggtcatcattttctaaagaatcaggaaaaaaacagagaatgaaaggagttcagcaaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagagtataataaaccagggaaaaaatggaaggttatgactcaggaatttattaatcagcacacagtggaacacaaaggaaaacaaatctgtaaatacttcctggaagggaggtgtattaagggagatcagtgtaaatttgatcatgatgcagagttggagaaaagaaaagagatctgcaaattttatttacaaggatattgtaccaaaggagagaactgcatttatatgcataatgaatttccatgcaagttctatcatagtggagcaaaatgttaccagggagacaactgtaaattttcccatgatgatctaactaaagaaacaaagaaacttttggacaaagtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagccaccagcattttataccagtgcctcaccaccaggaccacaatttcagggaagcagtccacaccctcaacatatctatagttctgggtcaagtccaggtcctggacctaacatgtctcagggacacagtagtcctgtgatgcacccaggctcccctggacatcacccatgtgcaggacctcctggtctaccagtgccacagagcccacctttaccacctggtccacctgaaattgtaggtcctcaaaatcaagctggagtgcttgttcaaccagacacatctttgacaccaccaagtatgggtggggcttaccactccccaggctttccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtgatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcacccaacctcatagggcaccaagcaaggaagaagatgatacagttaactggtattccagtagtgaagaggaagaaggaagcagtgtcaaatcaatactgaaaacattacagaaacaaacagaaactttaaggaatcagcaacaaccttccacagaactcagcactcctactgatccaagacttgctaaagagaaaagtaaaggaaaccaagtggttgaccctaggcttaggactatcccaaggcaagacattagaaagccttctgagtctgccccactggatcttagacttgcgtgggatcccaggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaatacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaactgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctgctaattaaaatgtaaaatcaagtaaagaaaacattttaaaattacaattagcagagcagttcatgtttaagggcatcacttttattagtattggcaatattatttgtgtaaatgaagcatttgaatgtcatatctttttaaagtattttattgtatactgtatcatagaagttggaggtatataaatagaacattttgctaaagtgaaaaatttccaagttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctggcattctgtaacagaggggattacctggtgttttaagtatttaatgtcctcatagtgtggaaatcccctaaattgattagaaattgtattttatgaaaaataacttgtattcattcttgtgtatttattacaatatataaataatggcaactctttgttttatacatatataatttataactgaatctaagtattagactgctactcatattttgaactgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatatatatatatcccaaggtgtaatttactcttttgtcaggataaaatcagaaaaatggctgattttagtaaatgaaatttttagcaaatctttcattcatgtagtttataattattgtgtcaagcagtgctgtttacattttaagcatcatacaaaaaagataatttggcttgctaaacatcaaaatagaatccaaactcttaaccgaatatcttttttacaactaaaagagatattccaagatttattaaagagtcaggtttaaaagttattaatgcaaattatgtaatgttcatttattcagtattcttgagtccctgttacctcaattggtgttctagaggctattttacaagaaagtttgaacttagtttcaaatttgacaatatattttatatgaaaatgtttatgtttaaaataacttatttattatgcagcatttttattgtgataacgttagtttatgggatattctgtcatatcctgtaaacatagtttatttttcttcttttttcccattttctcatacaaattgaataagtagccattttcccccaatgaatacctcttcttttaggtcaattggtgtttttagaatccatgtaatttgatttgcactgttagattgaaaagtaagttacgttcctgttcttagaagccacacatttagagataacagaaataacttgagtcttaagagtatggataggctcatccaatgagatgtaacttagctattcatactgtttgtgatggaaattctatacctgtttactgtgatgatgaatacagtggatatagcagggggttgaaatggaacacacagaagatcatgacaattgagattcagcaactgctgtctcatatcttggttaagacctcattgtgaaccttgaacacaaatcagatgttggagtgatttcaaactctatttcaacaattgggtctgtttctatatggaccctctatttcccagctgaatgtttcaaacccccaaattaggctgcaaccgaaagagcctaattgtgaaatgatgtgcgcttatgtttctgtttatcctttagccatggaactttaaagagtagtgttcctcctacttactttaagctggaagaagagttgagtagtaaatcctgtgtgaacttttagctcagctactctgctgaattaattagaggtaggaaggacttacaagggctggaagtttaaagagaataaattcatattttttgttctgaattgatttctgtgtaatttatatcagtatctagttgcttatctgtgaaattgggttaatttttattgatcacatttgatgtaaagaatgaattatttttgtaaagtatttgtaaatataaaattgctttataacttgaatgaacataatcattatgctcccattagggtgcattaagttgtacaaattccaaaataacatggtatggtttgtatggtttagcaattttacgaagcttcagatgacatgcactggtgacacaacagtagaatttcctgagaggttgagtgaatattaacccatcaagttagcaatttccttaactacatgagtatcaggaagacaggacttccctgccttagagctatatagacttgggcctcttcaagatctgacttctctgcacattctatacaggttggatattgatggagggttaaaaatgctatgacagttcatggtgcatggtgtgtttgtttaaatcatagcatgtttaggcaaagtggccagctcattcaatataagagccaccagctcttagaaacaacagatatattcacacccagtctgtaatatgtatttcttcaggcatgtcacactgcggtcttcctgaaagactacttacttcataaaggtattatgtttctttaattaatggccactagaagttaggaagctcctagggaccaggatatgagatcttaaagaggctgtcagaatctcttcatttgcatgacatagaatctgtggtggagatgttttccctgatgtttttggagggttggactgtgttgaaggctgtaccttggtgggggtggtctgcagtcatgcagtccactgatagggtcccccaccccgcaagcttcaataattgagctttctgttaatttcttgaattatcttttcaaaaatggtttggcagcacttgatgacattatgttcaaaattaagtccagtaaaatatataagcatttgtaaactataattatagtttaaataagacttagtttaggaaatccaagttttgacatatataaccaaacggcctaagagttcaaagctattttcttaggtgttacaccttagcatttacataatgccttctccccaagcagtttcatgtggtttgcagaaagttttggcagctaccagtcactatattgctggagttttgtgtttgagtatgtcatttatgtcatttatcagcagtatctgccagttgtgacaaagccctccctattatcctgcctttcctggaaaggatacagacccaagaaaagttaacatctacatagtacttagaatttctaattttaaaataagaaacaaaaagcacatttaaaataatattttatgcttttggagacaggacccacatgtatctccttatttttatacttgccatagaaacaagcctagttgtaggcctacagtgggtgctttgttaactgcttgttgatggcttcctgacatccatccaaatgtcacttttacagatgctgtcacccgttaaacaggtgtggcagaagtattccatgactgcattaggaagaatgcaccttatgggttatatctcttttggtagacagcccacctgctcttttttgtccccaccctcagcccaagcaatgtgaagacagattatggcaacttaggagctccatgtttccataataattcataactttaagagtcctccagacttacaagattacttcatggtgaaagtttggattgatcaataatttattcctataaaggtctgcaggattttttctgtaaccagaaaagtaactgcatagccattctttttttttttttttaatttgttgttgtttttgtttgagacagagtcttcattcttgttgcccaggctggagtgtaatggtgcaatctcggatcactgcaacctctgcctcccaggttcaagtgattctcctgcctcagactcccaagtagctgggcttacaggcacgtgccaccacacccagctaatttattgtatttactagagacggggtttcaccatgttgatcaggctgatcttgaactcctgaccccaggtgatccacccgcctcaacctccaaaagtgttggggttacaggcgtgagccaccgtgctcagcctgttttttatttatttttttgagacagtctcactttgtcgctcaggctgaagtgcagtggcgctatcagctcacagcagcctccgcctcccaggttcaagcaattctcccaccttagcttcctgagtagctggaactacaggtgtgtgccaccacacccagctaatttttgtatttttttggtagagacagggtttgaccatgttggccaagctgatcttgaactcctggcctcaagtgatccaccagtcttggcctctcaaagtgctgggatcacaggcatgagccaccacgcctggcccagtctttttttttaattattatttatttttatttatttattttttgagacggagtcttgctctgttgcccaggctggagtgtagtggcatgatcttggctcactgcaacctctgcctctgggttcaagcaattctcctgcctcagccttctgagtagctgggattataggcatgcgccaccacaaccagctaattttttatatttttggtagagacacagtttcatcatgttggcccggctggtctcaaactccttacctcaagtgatctgcccgcctcagcctcccaaagtgctgggattacaggcgtgagccactgtgcctggccagtcttttattttaaaataaatacttagtcctaacctagtgaattatcaatagcatttaaaattccttctatcctgataccatgaacagtaattttcccttttaagttatgatttgactctaattttgggtcttgtatctggtctttaaacacctttcgttaccctttggaatagaacaatcatgctactgttagcaaaattattgtaggcataaggaagagctgtgagttcaaagaagattgtgagttcttggaatagtattttacagcgttgtttattcttgaccttcttgttttttaagcttagagtttataagaaaaaagtgaatatatagctaattatagcattttagaaaaaattagctctgcagatagtcaggccccatacttcttggctcattactgattttaataccttcatgagagtattaaggttgaaaggaatggtgaaatttgcattatcagaggtctgatatgtaatttattgtaaagaaattaaatatatagaggctcaattaaaaaataaccatattctcaaacctccattaccactaatatcttggggttgtcaatgatagactatatatatatgtatgtatatgtgtgtatatatatatatatatatatatatatatatatatatatatatatatatatatatataattttttttttttgagacggagtcttgctctgtcacccaggctggagtacagctcacagcaacctctgcctcccaggttcaagcaattctgcctcagcctcccgagtagctggaattacagacgcctgccaccacacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctgtattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatccacaagcaatatctgtgggctgaaatccaggttatacctattcactatgactttttttttttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaataatatc

SEQ ID NO: 8680 - DNA, 11540 bp, Homo sapiens
ggcgccattttctcgagccgcctgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgagaaacataagcataattccccatctagtgatgatagttcggactacagccttgattcagatgttgaacatacagaaagttcccataaaaaaagaactggtttctacagggattatgacattccatttactcagcgtggacatatatcaggaagctacataacatcaaagaagggtcaacataacaaaaaatttaaaagtaaagaatatgatgagtacagcacctacagtgatgacaacttcggtaactacagtgatgacaactttggtaactacggtcaggaaacagaggaagattttgccaatcagctgaaacaatacaggcaagctaaagaaacctcaaatattgctttagggtcatcattttctaaagaatcaggaaaaaaacagagaatgaaaggagttcagcaaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagagtataataaaccagggaaaaaatggaaggttatgactcaggaatttattaatcagcacacagtggaacacaaaggaaaacaaatctgtaaatacttcctggaagggaggtgtattaagggagatcagtgtaaatttgatcatgatgcagagttggagaaaagaaaagagatctgcaaattttatttacaaggatattgtaccaaaggagagaactgcatttatatgcataatgaatttccatgcaagttctatcatagtggagcaaaatgttaccagggagacaactgtaaattttcccatgatgatctaactaaagaaacaaagaaacttttggacaaagtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagccaccagcattttataccagtgcctcaccaccaggaccacaatttcagggaagcagtccacaccctcaacatatctatagttctgggtcaagtccaggtcctggacctaacatgtctcagggacacagtagtcctgtgatgcacccaggctcccctggacatcacccatgtgcaggacctcctggtctaccagtgccacagagcccacctttaccacctggtccacctgaaattgtaggtcctcaaaatcaagctggagtgcttgttcaaccagacacatctttgacaccaccaagtatgggtggggcttaccactccccaggctttccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtgatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcacccaacctcatagggcaccaagcaaggaagaagatgatacagttaactggtattccagtagtgaagaggaagaaggaagcagtgtcaaatcaatactgaaaacattacagaaacaaacagaaactttaaggaatcagcaacaaccttccacagaactcagcactcctactgatccaagacttgctaaagagaaaagtaaaggaaaccaagtggttgaccctaggcttaggactatcccaaggcaagacattagaaagccttctgagtctgccccactggatcttagacttgcgtgggatcccaggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaatacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaactgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctgctaattaaaatgtaaaatcaagtaaagaaaacattttaaaattacaattagcagagcagttcatgtttaagggcatcacttttattagtattggcaatattatttgtgtaaatgaagcatttgaatgtcatatctttttaaagtattttattgtatactgtatcatagaagttggaggtatataaatagaacattttgctaaagtgaaaaatttccaagttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctggcattctgtaacagaggggattacctggtgttttaagtatttaatgtcctcatagtgtggaaatcccctaaattgattagaaattgtattttatgaaaaataacttgtattcattcttgtgtatttattacaatatataaataatggcaactctttgttttatacatatataatttataactgaatctaagtattagactgctactcatattttgaactgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatatatatatatcccaaggtgtaatttactcttttgtcaggataaaatcagaaaaatggctgattttagtaaatgaaatttttagcaaatctttcattcatgtagtttataattattgtgtcaagcagtgctgtttacattttaagcatcatacaaaaaagataatttggcttgctaaacatcaaaatagaatccaaactcttaaccgaatatcttttttacaactaaaagagatattccaagatttattaaagagtcaggtttaaaagttattaatgcaaattatgtaatgttcatttattcagtattcttgagtccctgttacctcaattggtgttctagaggctattttacaagaaagtttgaacttagtttcaaatttgacaatatattttatatgaaaatgtttatgtttaaaataacttatttattatgcagcatttttattgtgataacgttagtttatgggatattctgtcatatcctgtaaacatagtttatttttcttcttttttcccattttctcatacaaattgaataagtagccattttcccccaatgaatacctcttcttttaggtcaattggtgtttttagaatccatgtaatttgatttgcactgttagattgaaaagtaagttacgttcctgttcttagaagccacacatttagagataacagaaataacttgagtcttaagagtatggataggctcatccaatgagatgtaacttagctattcatactgtttgtgatggaaattctatacctgtttactgtgatgatgaatacagtggatatagcagggggttgaaatggaacacacagaagatcatgacaattgagattcagcaactgctgtctcatatcttggttaagacctcattgtgaaccttgaacacaaatcagatgttggagtgatttcaaactctatttcaacaattgggtctgtttctatatggaccctctatttcccagctgaatgtttcaaacccccaaattaggctgcaaccgaaagagcctaattgtgaaatgatgtgcgcttatgtttctgtttatcctttagccatggaactttaaagagtagtgttcctcctacttactttaagctggaagaagagttgagtagtaaatcctgtgtgaacttttagctcagctactctgctgaattaattagaggtaggaaggacttacaagggctggaagtttaaagagaataaattcatattttttgttctgaattgatttctgtgtaatttatatcagtatctagttgcttatctgtgaaattgggttaatttttattgatcacatttgatgtaaagaatgaattatttttgtaaagtatttgtaaatataaaattgctttataacttgaatgaacataatcattatgctcccattagggtgcattaagttgtacaaattccaaaataacatggtatggtttgtatggtttagcaattttacgaagcttcagatgacatgcactggtgacacaacagtagaatttcctgagaggttgagtgaatattaacccatcaagttagcaatttccttaactacatgagtatcaggaagacaggacttccctgccttagagctatatagacttgggcctcttcaagatctgacttctctgcacattctatacaggttggatattgatggagggttaaaaatgctatgacagttcatggtgcatggtgtgtttgtttaaatcatagcatgtttaggcaaagtggccagctcattcaatataagagccaccagctcttagaaacaacagatatattcacacccagtctgtaatatgtatttcttcaggcatgtcacactgcggtcttcctgaaagactacttacttcataaaggtattatgtttctttaattaatggccactagaagttaggaagctcctagggaccaggatatgagatcttaaagaggctgtcagaatctcttcatttgcatgacatagaatctgtggtggagatgttttccctgatgtttttggagggttggactgtgttgaaggctgtaccttggtgggggtggtctgcagtcatgcagtccactgatagggtcccccaccccgcaagcttcaataattgagctttctgttaatttcttgaattatcttttcaaaaatggtttggcagcacttgatgacattatgttcaaaattaagtccagtaaaatatataagcatttgtaaactataattatagtttaaataagacttagtttaggaaatccaagttttgacatatataaccaaacggcctaagagttcaaagctattttcttaggtgttacaccttagcatttacataatgccttctccccaagcagtttcatgtggtttgcagaaagttttggcagctaccagtcactatattgctggagttttgtgtttgagtatgtcatttatgtcatttatcagcagtatctgccagttgtgacaaagccctccctattatcctgcctttcctggaaaggatacagacccaagaaaagttaacatctacatagtacttagaatttctaattttaaaataagaaacaaaaagcacatttaaaataatattttatgcttttggagacaggacccacatgtatctccttatttttatacttgccatagaaacaagcctagttgtaggcctacagtgggtgctttgttaactgcttgttgatggcttcctgacatccatccaaatgtcacttttacagatgctgtcacccgttaaacaggtgtggcagaagtattccatgactgcattaggaagaatgcaccttatgggttatatctcttttggtagacagcccacctgctcttttttgtccccaccctcagcccaagcaatgtgaagacagattatggcaacttaggagctccatgtttccataataattcataactttaagagtcctccagacttacaagattacttcatggtgaaagtttggattgatcaataatttattcctataaaggtctgcaggattttttctgtaaccagaaaagtaactgcatagccattctttttttttttttttaatttgttgttgtttttgtttgagacagagtcttcattcttgttgcccaggctggagtgtaatggtgcaatctcggatcactgcaacctctgcctcccaggttcaagtgattctcctgcctcagactcccaagtagctgggcttacaggcacgtgccaccacacccagctaatttattgtatttactagagacggggtttcaccatgttgatcaggctgatcttgaactcctgaccccaggtgatccacccgcctcaacctccaaaagtgttggggttacaggcgtgagccaccgtgctcagcctgttttttatttatttttttgagacagtctcactttgtcgctcaggctgaagtgcagtggcgctatcagctcacagcagcctccgcctcccaggttcaagcaattctcccaccttagcttcctgagtagctggaactacaggtgtgtgccaccacacccagctaatttttgtatttttttggtagagacagggtttgaccatgttggccaagctgatcttgaactcctggcctcaagtgatccaccagtcttggcctctcaaagtgctgggatcacaggcatgagccaccacgcctggcccagtctttttttttaattattatttatttttatttatttattttttgagacggagtcttgctctgttgcccaggctggagtgtagtggcatgatcttggctcactgcaacctctgcctctgggttcaagcaattctcctgcctcagccttctgagtagctgggattataggcatgcgccaccacaaccagctaattttttatatttttggtagagacacagtttcatcatgttggcccggctggtctcaaactccttacctcaagtgatctgcccgcctcagcctcccaaagtgctgggattacaggcgtgagccactgtgcctggccagtcttttattttaaaataaatacttagtcctaacctagtgaattatcaatagcatttaaaattccttctatcctgataccatgaacagtaattttcccttttaagttatgatttgactctaattttgggtcttgtatctggtctttaaacacctttcgttaccctttggaatagaacaatcatgctactgttagcaaaattattgtaggcataaggaagagctgtgagttcaaagaagattgtgagttcttggaatagtattttacagcgttgtttattcttgaccttcttgttttttaagcttagagtttataagaaaaaagtgaatatatagctaattatagcattttagaaaaaattagctctgcagatagtcaggccccatacttcttggctcattactgattttaataccttcatgagagtattaaggttgaaaggaatggtgaaatttgcattatcagaggtctgatatgtaatttattgtaaagaaattaaatatatagaggctcaattaaaaaataaccatattctcaaacctccattaccactaatatcttggggttgtcaatgatagactatatatatatgtatgtatatgtgtgtatatatatatatatatatatatatatatatatatatatatatatatatatatatataattttttttttttgagacggagtcttgctctgtcacccaggctggagtacagctcacagcaacctctgcctcccaggttcaagcaattctgcctcagcctcccgagtagctggaattacagacgcctgccaccacacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctgtattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatccacaagcaatatctgtgggctgaaatccaggttatacctattcactatgactttttttttttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaat

SEQ ID NO: 8681 - DNA, 3127 bp, Homo sapiens
tgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaaaaaaatccaaaaggagaaaacgtgagaaacataagcataattccccatctagtgatgatagttcggactacagccttgattcagatgttgaacatacagaaagttcccataaaaaaagaactggtttctacagggattatgacattccatttactcagcgtggacatatatcaggaagctacataacatcaaagaagggtcaacataacaaaaaatttaaaagtaaagaatatgatgagtacagcacctacagtgatgacaacttcggtaactacagtgatgacaactttggtaactacggtcaggaaacagaggaagattttgccaatcagctgaaacaatacaggcaagctaaagaaacctcaaatattgctttagggtcatcattttctaaagaatcaggaaaaaaacagagaatgaaaggagttcagcaaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagagtataataaaccagggaaaaaatggaaggttatgactcaggaatttattaatcagcacacagtggaacacaaaggaaaacaaatctgtaaatacttcctggaagggaggtgtattaagggagatcagtgtaaatttgatcatgatgcagagttggagaaaagaaaagagatctgcaaattttatttacaaggatattgtaccaaaggagagaactgcatttatatgcataatgaatttccatgcaagttctatcatagtggagcaaaatgttaccagggagacaactgtaaattttcccatgatgatctaactaaagaaacaaagaaacttttggacaaagtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagccaccagcattttataccagtgcctcaccaccaggaccacaatttcagggaagcagtccacaccctcaacatatctatagttctgggtcaagtccaggtcctggacctaacatgtctcagggacacagtagtcctgtgatgcacccaggctcccctggacatcacccatgtgcaggacctcctggtctaccagtgccacagagcccacctttaccacctggtccacctgaaattgtaggtcctcaaaatcaagctggagtgcttgttcaaccagacacatctttgacaccaccaagtatgggtggggcttaccactccccaggctttccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtgatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcacccaacctcatagggcaccaagcaaggaagaagatgatacagttaactggtattccagtagtgaagaggaagaaggaagcagtgtcaaatcaatactgaaaacattacagaaacaaacagaaactttaaggaatcagcaacaaccttccacagaactcagcactcctactgatccaagacttgctaaagagaaaagtaaaggaaaccaagtggttgaccctaggcttaggactatcccaaggcaagacattagaaagccttctgagtctgccccactggatcttagacttgcgtgggatcccaggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatac

SEQ ID NO: 8682 - DNA, 1753 bp, Homo sapiens
gcgccagcgaccatggcggagcccacagtgtgctccttcctcaccaaggtgctgtgcgcccacggcggccgcatgttcctgaaggacctgcgcggccacgtggagctgtcggaggccaggctccgggacgtgctgcagcgcgccgggcccgagcgtttcctgctgcaggaggtggagacgcaggagggcctcggggacgcggaggccgaggcggcggccggcgcggtgggcggtggcggcacctccgcctggagggtggtggccgtgtcctctgtgcgcctctgcgcccgctaccagcgcggcgagtgccaggcctgcgaccagctgcacttctgccgccggcacatgctgggcaagtgccccaaccgggactgctggtctacctgtaccctttcccatgatatccacacacctgtcaacatgcaggtcctgaaaagccatggactttttggtctcaatgaaaaccagcttcggatcctgcttttgcagaatgacccctgtcttttaccagaggtctgtttgctctacaacaaaggggaagccctgtatggctactgcaacctcaaggataaatgcaacaagtttcatgtgtgcaaatcctttgtgaaaggagaatgcaaacttcagacctgcaaacggtcccatcagcttatccatgctgcatctttgaagctgctacaggaccaaggactgaatattccaagtgttgttaattttcagataatctccacctacaagcatatgaagctgcacaagatgcttgaaaatacagataattcatcaccttcgactgagcattcacaaggccttgagaagcaaggagtgcacgcagctggagctgcagaagctggtcctctggcttctgtccctgctcagtcggccaagaagccctgcccagtgtcttgcgagaagtaaagaagatggaaaaggagaaaatgtccttttggaagaatacatttgggcatgggtggttggggatggggtgggacattgaacaggcaaagagaggctaaaattgagtgcagatggggctagtccagggcaagtgctgaagatggcagctgctatctgcagctcctaggtgctttcctcaggctgggtagatggagctctgctgacttctgtggtccaccattgtttttctatcaatttatattgtggcaatcctagagtactttgcactcatttttttttttcacttaatattgtctcataagcatctttctatatttgttcacatcgtacataatcatgtttttgcacagatacattaatattatcatagtttgtttaactacttggctttttctaacagtttttttttttgagatggtcttgctctgttgcccaggctggagtgcagtgacgtgatctcggctcactgcagccttgacttcctgggctcaagtgatcatcccacctcagcctcctgagtagctgggactacaggtatgcaccacgaccagctaattttttgtattttttttttgtagagagggtattttgccatgttgcccaggctagtcttgaactcctgggctcaagcgatctgcctgcttcagcctcccagagtgctaggattacaggcatgagccactgcacccagcctcttaacaaattttgaatataactcctgtcttaaaatctgcagaatattgaatttttccagctattttttacttttgcttagcttatagatgctaaaggatactgtcatttgcatttttaaaaatatatgtatgagtgaatagtt

SEQ ID NO: 8683 - DNA, 309 bp, Homo sapiens
atggcggagcccacagtgtgctccttcctcaccaaggtgctgtgcgcccacggcggccgcatgttcctgaaggacctgcgcggccacgtggagctgtcggaggccaggctccgggacgtgctgcagcgcgccgggcccgagcgtttcctgctgcaggaggtggagacgcaggagggcctcggggacgcggaggccgaggcggcggccggcgcggtgggcggtggcggcacctccgcctggagggtggtggccgtgtccgggactataggtgcatgccaccatactcagctaatctttttaggtttttag

SEQ ID NO: 8684 - DNA, 2110 bp, Homo sapiens
gagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagccctaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcg

SEQ ID NO: 8685 - DNA, 331 bp, Homo sapiens
cccatggtaggcctgctggttcacactgcagctactttcaactattcctttagaaagatcagaggccttctgtgccctcaacacaagcaaagaggagtgcaggcaaaccaaacacctgtcctttttcttcacataagctgtgtatattactccttgtatctttttttccttttttgctgtcttttcttaatacctttggaacaaaagatgacaacctcgcctttaccttatccatgtgacaacatccatgttacagtctggcctcttggggaagtattaatggaaaccaggatgtgggagagtaagataggcttagagatgagactttaaa

SEQ ID NO: 8686 - DNA, 2118 bp, Homo sapiens
ctttctggctcttggaacgctcggctctgagaggctccaggtttctccgccagagctcctgtcgctctgtcagttgcgctgtgttcctctctagtcacaagagccttggggaagacagttggaagctcagacatgagaaatatgattccacaggacaatgaaaacccaccccaacagggtgaagcaaatcaaaatgatttcgctcttgttgcccaggctggagtacagtggctcgatctcggcccacagctgcctctgcttcctgggttcaagcaattcttctgcctcagcctcctgagtagctgtggttacagttggagtcttgctctgtcacccaggctggagtgcagtggcgcaatctcagcttacggcaagctccgcctcccgggttcatgccattctcctgcctcagcctcccgagtagctaggactacaggcgcccgccaccacacccggctaatttttgtatttttagtagagacaaggtttcaccgtgttagccaggatggtctcgatctcttgacctcgtgatctgcccacctcggtctcccaaagtgctgggatgacaggcgtgagccaccatgtccagctgtaacttagaactatttaaagaggcaaaggcataggagaataaaggaaggaagaagtaactcgtggaatgttgcgaaaggaaaaacacgtttaaggaagaggaacaggctatgacttaatgtttgcttggaccagtataagcatgccagggcaagtatttaggctaacttgtgggagttaagaatataaagttgccaagaccagcttggctggggagacgctaacccagcagcgctagaggaattaaagacaccacacacaccaaaatatagaggtgtgaagggggaaatcaggggtctcacagccttcagagctgagagtcttgaacagagatttatccacatatttattaacagcaaaccagtcattagcattgtttctatagatattaaattaactaaaagtatcccttatgggaaacaaagggatgagccgaattaaaggaataggttgggctagttaactgcagcaggagcatgtccttaaggcacagatagctcatgctactatttgtggcttaagaatgcttttaagcggttttccgccctgggcgggccaggtgttccttgccctcattctggtaaactcacaaccttccagtgtgggtgttagggccattatgaacatgttacagtgctgcagagattttgtttatggccagttttggggccagtttatggccagattttggggggcctgctcccaacatgtcccctttctttgatttgcaaatcaataaaagcaagggcagctttgtcacagtgagctacttctcgcaggagtcaggatccacgtctgcagactatacaaggacaacacagattaaaagcacagtcatcattgaaatcacagaacttccaagtgtttttatccattttcagctccttttaagcactccagttctggcattaaggtcagctgtgcctgggatgctttaaatatttgttcttttaattttaaatccttatattaagctcctacaatgcaccatatcatttgaggttgaggtgccactataccgccatggttccagataataggaacttttgccatacttcttatcatttctgccatctgaccgttttgttcagatcagctgaacatagtgtggccgtggcatgtagactgagaggtgcagtttaagctaaacatccccttaggggaccaattaataatgattccatagaaattgttgtgcagcacctctgcctgttccgcaatgcaatcttcctaaacaagtacgttcattttttctaactgggtccgatcctgtttacaaataggtttttgagggcggtatgcctcaattataggagcagatttattacggtaaatactgagattagaaagcatgtgtaactgtgtcatagagtgattgcatccaggcattattaccagtcaagattgataaatatgcccagtaagtataatcattctctgtgtcagcccttattgaaggaatactcaaggtagtggtgataactgctgtcatagctaccattaaattattcattgtgactggttgtc

SEQ ID NO: 8687 - DNA, 2059 bp, Homo sapiens
gttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcat

SEQ ID NO: 8688 - DNA, 1965 bp, Homo sapiens
cttggagacgactggcgagaggaagagggactaggtccaaacgctaggtggctgggtccagatacctgtgttttgactctgttcctgtggatagctgcttggtctgaagttccagaaaggatcctgttcccagacagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccacctt

SEQ ID NO: 8689 - DNA, 4229 bp, Homo sapiens
gcggccgccccgcgcgcatcgccatgtgagcggctgccgcggcttcgcggggacccaactttcccgggcggcggcgcccaacttcccgccgcccgctccggccccgcaggcccgcggcgccaggggaagacgcgagtaagtgcgggcggcggtgccctcccggccctcaccccgcacgcggcgacccggccgcctagcctccctcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaacta

SEQ ID NO: 8690 - DNA, 3586 bp, Homo sapiens
agtgcttgttggggccaggctttgtaacggtctcctgagcagcgagcagaaaatctgttatcgagagagagtgagcacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaaatggccaaaccccagtcctgcaagctgtacaagaagcatgacaccagcatctgcatctggtgaggactcaggaagcttctactcatggcagaaggcaaagagggaacaggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagct

SEQ ID NO: 8691 - DNA, 3191 bp, Homo sapiens
aaagtgaaatggccgcccgggacgagctcggcctcggcggggattctcttgaggccatgcccgtgccggccgccagaggtcgcccgaggatcacgaatgggcccgaggagctggctgccccttcccccgcggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatca

SEQ ID NO: 8692 - DNA, 1627 bp, Homo sapiens
gtgcgcaggcgcgttggtttcccgacctgaagaggcgccgtcttcccgggtcccgagcactctgtgccggaggactctgcccttgtccacaaggagagcacacaggagagaatggctgctgtgtctccgaccaccagatgccaggaatcagtgacattcgaagacgttgccgtggttttcacagatgaagagtggagtcgtctggtccccatacagagggacctctacaaggaggtgatgctggagaactataacagcattgtgtcattggactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttatagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagca

SEQ ID NO: 8693 - DNA, 2049 bp, Homo sapiens
atgattccaaagcaggacatttctgaagaattggaatcccagagagcaaaatcagaagatcatgtaaggaatatttttaaggaaactgaagagatgagtaaaactgagggaaagttagagaattgctggagaaaatatgcagtagaaggagttaagaactcattctcccagaagagcaatttcagagaaattaccatgaggtatgtgaaaaccctctctagagagaatggccagaagttcaatgctgttggagaaaactgcattacagactcaaatcctgccaaacatcttagagggtctagagaggagagtctccatccaagtgtgtcaagtgtagaaaacttgcaacaacatgaggacctcattaacctccagagtttccaattaggagaaagagcctatcagacagatgtgttagtgaaagtgcccagacagagctcagttcttagtgagaatcagaggatgaataatccagagagatggtttgagagtactgggtgtggaaaaacttacaatcagaacagagcttttaaccagcaccagagatttcatagtggagagaagacctatgagcacaatgaatgtggaaaagctttcagttggccctctatcctcagtaaacatcagagaatccacactggtaagaaactctacacatgtgaggattgtggcaaatctttcagtgttcactcatactttattcagcattgtaaaattcacactagagaaaaaccctatgagtgtattaaatgtgggaaagcttttagtacacattcatcttatgttcaacatctaaaaattcatacaggagagaaacatcatgagtgtaatcagtgtgggaaagcctttagtcatagctctaatctaattcatcatcagagaattcatagtggagagaaaccttacaagtgcaaagaatgtgggaaagccttcaacagacaatcaaaccttattcagcatcagagaattcattctggagagaaaccttatgactgtaaggagtgtggcaaagccttcagtacacaattatttctcattcagcatcagagaattcatacaggagaaaagccctatgaatgtaatgaatgtgcaaaatcctttagcctgaaccgaactcttactgtccatcagagaattcacactggagagaaaccttataggtgtaatgaatgtgggaaatcctttagtcaatgctcacaagttattcaacataagagaattcacactggagagaaaccttatatctgcaatgagtgtggaaaatcatttggtgctcgtctatcccttatccagcatcagagaattcacactggagagaaaccttatggttgtagagagaaaccctatgaatgtagtgagtgtggaaaagctttcagccagagttttaatcttattcaccatcaaagaacacacaatggtgagaagtcctatgaatgtaatgaatgtgataaagccttcagtttgctttcttcccttgttcaacatcagagaatacataatggagacaaaccctatgagtgtcacaaatgtgggaaggcctttagccaggggtcacaccttattcagcatcagaggagtcacattggtgagaaaccctatgagtgtaatgagtgtgggaaaacctttgggcagatatccaccctaattaagcatgagagaacacacaatggagagaagccctatgagtgcagtgactgtgggaaggccttcagccagagtgcacaccttatccaccatcaaagaattcacactggagagaatccctatgagtgcagtgaatgtgggaaggccttcaatgtttgttcctctctcattcagcatcacagaattcatactggtgagaaaccttatgaatgtagtgactgtggcaaggcgttcagtcagcattcacaatttatccaacatcagagaattcacactggagagaaaccctacatgtgcaatgagtgtgagaaatccttcagtgcatgcttatcccttatccaacacaagagaattcacactggagagaaaccctatgtatgtgccaaatgtggaaaatccttctga

SEQ ID NO: 8694 - DNA, 1642 bp, Homo sapiens
tttagcgttcgcgctccttcccttcccgtggtcgagccgagtcctgacctgagggctgcatcaagatcttgtcattccacatcgtggtttcctttgaggatgtggctgtacccctctcccaggaggagtgggactgtctgatccctgctcagaggggcctctacaaggatgtgatgatggggacctatgggaacctactctcattaggctgtgattctaggattgaaaaagaggaaatgattccaaagcaggacatttctgaagaattggaatcccagagagcaaaatcagaagatcatgtaaggaatatttttaaggaaactgaagagatgagtaaaactgagggaaagttagagaattgctggagaaaatatgcagtagaaggagttaagaactcattctcccagaagagcaatttcagagaaattaccatgaggtatgtgaaaaccctctctagagagaatggccagaagttcaatgctgttggagaaaactgcattacagactcaaatcctgccaaacatcttagagggtctagagaggagagtctccatccaagtgtgtcaagtgtagaaaacttgcaacaacatgaggacctcattaacctccagagtttccaattaggagaaagagcctatcagacagatgtgttagtgaaagtgcccagacagagctcagttcttagtgagaatcagaggatgaataatccagagagatggtttgagagtactgggtgtggaaaaacttacaatcagaacagagcttttaaccagcaccagagatttcatagtggagagaagacctatgagcacaatgaatgtggaaaagctttcagttggccctctatcctcagtaaacatcagagaatccacactggtaagaaactctacacatgtgaggattgtggcaaatctttcagtgttcactcatactttattcagcattgtaaaattcacactagagaaaaaccctatgagtgtattaaatgtgggaaagcttttagtacacattcatcttatgttcaacatctaaaaattcatacaggagagaaacatcatgagtgtaatcagtgtgggaaagcctttagtcatagctctaatctaattcatcatcagagaattcatagtggagagaaaccttacaagtgcaaagaatgtgggaaaacctttgggcagatatccaccctaattaagcatgagagaacacacaatggagagaagccctatgagtgcagtgactgtgggaaggccttcagccagagtgcacaccttatccaccatcaaagaattcacactggagagaatccctatgagtgcagtgaatgtgggaaggccttcaatgtttgttcctctctcattcagcatcacagaattcatactggtgagaaaccttatgaatgtagtgactgtggcaaggcgttcagtcagcattcacaatttatccaacatcagagaattcacactggagagaaaccctacatgtgcaatgagtgtgagaaatccttcagtgcatgcttatcccttatccaacacaagagaattcacactggagagaaaccctatgtatgtgccaaatgtggaaaatccttctgacaaagctctcaccttattcaacatcagagaattcacagtggggagcaacc

SEQ ID NO: 8695 - DNA, 2590 bp, Homo sapiens
gatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatc

SEQ ID NO: 8696 - DNA, 2635 bp, Homo sapiens
aagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcagcgtcagtacccagagtgttacctggcaccaaatggatgcttagtaagtaattgtggagtgaataagatgagtaatgaagaactggtggggcagaatcatggcatggaaggtgaagcttgcacaggaggggatgtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgc

SEQ ID NO: 8697 - DNA, 2600 bp, Homo sapiens
gtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatcatgaac

SEQ ID NO: 8698 - DNA, 572 bp, Homo sapiens
gtcagtcccgcgatagcttcaggcctggcggcggcttccaagctaaggaacggtttggggcagtgtcgttcccggaggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctg

SEQ ID NO: 8699 - DNA, 2849 bp, Homo sapiens
gtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgtgggtcgcggcgacggcggggctaaggccctgggtccgcgcgcggtttgaccacggccggggccttgggcatttcctggccttcctgttgagccgtgtaaacgcggggtgatgacggcgccgacctcttggcactgttgtgagagcgaagtgggcgcgagagcagacgccagctacagttttttttgggttatgtcgtcatgaagccggcgctttcagttgtgcaaccttgaacaaatgggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 8700 - DNA, 675 bp, Homo sapiens
ggttcgccgtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtagcaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagta

SEQ ID NO: 8701 - DNA, 854 bp, Homo sapiens
ctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtagcaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacac

SEQ ID NO: 8702 - DNA, 2730 bp, Homo sapiens
agcatccattcatatattcattcagtcagctaatttttaatccagcacatactattgcaagcgctgttttaggcgttgagaatacaactgtgaacaagacgacaaaaattcctgccctcatggagcctaagagcctagattttagcgaaggtagaaccaccgtaaacaatgtatatattaataagtaacttatgcaccatactggaaaattataaagtgctatagaggaaaagaagaattcatgtaaagcaagggaaacaagatgtgagatcacagcggtttagtgttgctaatgaaccccaaatccagggcagtgtttgacacattaagccaaacagtagcggcactgtgggtcaagaagggccctttggctggcaccaccaaaacatgtgttctccaaaggaggctggcatcaactggagccacttcacagcttgtttgagaactggatctgaccagtaggaagaaaccaggacagcagtggaagactgttaaagaaacctgagtaaaaagatgcaggaggttgtgctgttggatgagagttcaggaccaccaagccagctgctttggacccgccaggatacccagctccctcaggaaagcgctctattacctgctccatatcctgccttcactaaagatggaagccaaggaaacctgccgcaagcagatatcacactaatgagccaggcccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagatcagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtgctt

SEQ ID NO: 8703 - DNA, 2503 bp, Homo sapiens
atatttctgtttctcatttcttggggagagtaccggcgggaagcatccattcatatattcattcagtcagctaatttttaatccagcacatactattgcaagcgctgttttaggcgttgagaatacaactgtgaacaagacgacaaaaattcctgccctcatggagcctaagagcctagattttagcgaaggtagaaccaccgtaaacaatgtatatattaataagtaacttatgcaccatactggaaaattataaagtgctatagaggaaaagaagaattcatgtaaagcaaggaggctggcatcaactggagccacttcacagcttgtttgagaactggatctgaccagtaggaagaaaccaggacagcagtggaagactgttaaagaaacctgagtaaaaagatgcaggaggtaagaagaggagggtctgtgatacatcacaaggaggaagaaggagaagtgagtccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagatcagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtg

SEQ ID NO: 8704 - DNA, 1252 bp, Homo sapiens
agttgtctggtgctgctatataggggacgtggggtccccacagacctgcaggttccggcccctcttttctcaacccagagcaaattgaaacgtccgggtgagagtccgatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaatgcctccttaattttgacatcccaaagaatttcttgtagtcccaaaacccgtatttctaataactatgggaataattccctccattcttcattacccatacaaaaattgggaagtacacatgagagaaaaatctttccaatgtaatgagagtggcaaatcctttaattatagctaactcttaaggaaatatcagataatccatttaggatagaaacaatataaatgtgaggtatgtgacaaggtctttaatcagaattgattccttgtatgccataatagatgtcacactggtaagaaaccttacagttgttatgagtgtggcaagaccttcagtcagacgtcatcctttacatgctatcgtagacttcatactggagggaaaccttacaagtgtagtgagcataacaagacctttggttgaaattcagcccttgtaattcataaggcaattcatactggagagaatccttgcaagtgtaatgaatgtggcaaggtttttaatcagaaagcacaccttgcacgtcatcatagacttcatactagagagaagccttacaaatgtgaagaatgtg

SEQ ID NO: 8705 - DNA, 2910 bp, Homo sapiens
gggggtggggctgcgccggcctcttcccagccagcttgaaagggtttgcgtagccggccttgtgggcccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaacctta

SEQ ID NO: 8706 - DNA, 2562 bp, Homo sapiens
attggggtgctgcagccccgccacctgttccgtagcttgccggtgccccgaaggtgagtcttggccccttgtcgcgacccgccaggttcccagaagatttcaggtctgtgccttggagtaggcggggagggaacgtctgcgcaggcgtgacccccgcccctacacattcactggcctgaagcccccgtggagtaggtggaggtcccgccccttatcctgaagattaaacagcctttctttgtctgagataacgcccggagttctttgtcctgcctccaagacgataaaggagcgcagacacaaaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactg

SEQ ID NO: 8707 - DNA, 1841 bp, Homo sapiens
caggtgccattgacattcagcgatgttgccatagacttctctcaggaggagtgggaatatttaaactcggatcagagggatttgtacagagatgtgatgttggagaattatactaacttggtctcattggactttaatttcacaactgaaagcaacaagttatcttcagaaaaaagaaattatgaagtaaatgcgtaccatcaggagacatggaaaagaaataaaaccttcaaccttatgaggtttattttcagaactgacccacagtacacaattgaatttgggagacaacagagacctaaagtgggatgttttagtcaaatgatattcaaaaaacataaatcccttcctctacataagagaaataacacaagagagaaatcatatgagtgtaaggaatataagaagggctttagaaaatatttgcaccttactgaacatctgagagaccatactggtgtgataccctatgaatgtaatgaatgtggaaaagcatttgtagttttccagcattttattagacatcgaaaaatccacactgatttgaaaccctatgaatgcaatggatgtgagaaggcctttaggttttattcacagcttattcagcatcagataattcatactggtatgaaaccctatgaatgtaagcaatgcgggaaggcttttagacgtcattctcaccttacagaacatcagaaaattcatgttggcttgaaaccctttgaatgtaaggaatgtggggaaacgtttagattatatcgacatatgtgtctgcatcagaaaattcatcatggtgtgaaaccctacaaatgtaaagaatgtggaaaggcttttggtcatcgttcaagtctttaccaacataagaaaattcattctggtgagaaaccatataaatgtgaacaatgtgaaaaggcctttgttcgcagctatctacttgttgaacatcaaagaagtcatactggtgagaaacctcatgaatgcatggaatgtggaaaggcttttggtaagggctcaagccttcttaaacataagagaattcatagtagtgagaaactctatgattgtaaggattgtggaaaggccttttgtagaggctctcaacttacacagcatcagagaattcatactggtgagaagccacatgaatgtaaagaatgtgggaagacttttaagcttcattcatatcttattcaacatcagataattcatactgatttgaagccatatgaatgtaagcaatgtgggaaagccttcagtcgtgttggagaccttaagacacatcaatcaattcatgctggggagaaaccctatgaatgtaaggaatgtggaaaaacctttagacttaattctcaactaatttatcatcagacaattcatactggtttgaaaccctatgtatgtaaagaatgtaagaaggcctttcgttctatctcaggtctttctcaacataagagaattcatactggtgaaaaaccctatgaatgtaaagaatgtgataaggcctttaatcgcagtgatcgacttactcaacatgagacaattcatactggtgtgaaaccacagaaatgcaaagaatgtggtaaggcctttagtcattgctatcaacttagtcaacatcaaagatttcaccatggtgagagactcttaatgtaatgagagggaaagcctttagccatggcacatttttactgttgtcactattatgatgctatagtgaagattaaactagttaatatagaatataaatacttggaaaggcatctggcacatcgtatttgcttactaaatacattatttttatgataattgttagaattactaaaaataaatcttatagaagg

SEQ ID NO: 8708 - DNA, 2269 bp, Homo sapiens
aaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtc

SEQ ID NO: 8709 - DNA, 2370 bp, Homo sapiens
cggaaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctgggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtc

SEQ ID NO: 8710 - DNA, 2380 bp, Homo sapiens
cggaaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggagtattatcctatgtgggagcacaggaaagagccctggaccatagaaagccaagtacgagtagcaagaaaaccaaaagggtgggaatggatcaaaggtgtgaaaacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtc

SEQ ID NO: 8711 - DNA, 2478 bp, Homo sapiens
cggaaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggagtattatcctatgtgggagcacaggaaagagccctggaccatagaaagccaagtacgagtagcaagaaaaccaaaagggtgggaatggatcaaaggtgtgaaaacaggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtc

SEQ ID NO: 8712 - DNA, 2630 bp, Homo sapiens
aaacggatcgcgttgggtgaaggtgacggcgtcgagcgacctctctgacctcatctcctgcctgtgtcctcctcgctccctctgctccagccaagcatgcgtccttcctgttcctgggccgagcttgctcctgcctcaaggccttcacgtgggctgtgcctctgctggaactcgctggcccctcagctgcagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggagtattatcctatgtgggagcacaggaaagagccctggaccatagaaagccaagtacgagtagcaagaaaaccaaaagggtgggaatggatcaaaggtgtgaaaacaggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtc

SEQ ID NO: 8713 - DNA, 2529 bp, Homo sapiens
gcatgcgcagtttcctacaggcccggaaacggatcgcgttgggtgaaggtgacggcgtcgagcgtgagtgaccctctgtgtagattaaacctgcgctccctgtttcccatttccacagccgatgtccagggtcgatacggcccttaaaatccccgtacactccaccccaggtgggagacaatgccttggagctgcaaatcttctctgagtctgaagcatcctgcctgacgcgtttgctcacattgacccgtgccttccctcagtccttctcatctctactgagattccgtctcaccctgaccctgtgacatgaacttctgaagagtccactgggcatggtcctgggaagggctcacacccagacatggatggagacgggttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtc

SEQ ID NO: 8714 - DNA, 1394 bp, Homo sapiens
gcgcgttcctgccccgcacacgcacgcgcgaacccttcagcttcttgttcctttgggccgcgggctgtaccaagtaaacccaggcagcgaggggcaaagcacggcgccccccgcgcgggtctcgtcgacggcccgacgcgcatagcccctcttcccacagcgctacaggactagtccgtctcgccgcgcaagcgccctaggctcttcacgccccctgcgcgctgtcctaccctacttgcgacgcaggcgcagaggctgggcgtgcagccgccgccgcagagccggagcgggggccgccggcgccgcatccctctctacctgccaacatcctgtattagagaacttgtggccggaggtgtggctgtggagagctggccggggagggacgctgctcagctgctgctctgctcctgtctcctgtcccctcccccggtcatgacagagacccgtgagccagctgagactgggggctacgccagcttggaagaagatgatgaagacctttccccaggccccgagcattcctctgattcagaatacactctctcagagccggactccgaagaggaagaagatgaggaggaggaggaagaggagaccactgacgatcctgaatatgatcctggctacaaggtgaagcagcgccttggcgggggccgtggtggcccatcccgccgggccccccgtgcagcccagcccccggcccagccttgccagctctgtggccgctcaccccttggggaggccccaccgggaaccccaccctgccggctctgctgccctgctacagccccccaggaagcaccagcccctgaaggcagggccctcggggaggaagaggaggaaccacctcgggctggggagggccgaccagctgggcgggaggaggaggaggaagaggaggaggagggaacctaccactgtacggaatgtgaggattccttcgacaacctgggggagctgcacgggcacttcatgctgcatgcccggggtgaggtgtaggcagagcccccatacggggagcttggcagaaggggtggggtgggaggagggggctgaggaaattggggttgtgacagtggtcatgggggatggggtactgccggtctgtgttgtcttagaagtagatgtgtgatggccagaataaaagccaaaatctgtatctgtgtgtgttggttcagagtgtgtgtgtgtgtgtgtgtattcccgcccgtgtgtgtgtttgtgtgtgtgtgtgtgtgtgtgtattccccctgggctccttcttggggaaccttggggtcttttgggaaagataacatttactgcgtgcttgtattcgatgaggtttccatgtatttacttacagaccccataatgtaaaggctctaataatagaattttgtttctcactc

SEQ ID NO: 8715 - DNA, 553 bp, Homo sapiens
gggcgtgcagccgccgccgcagagccggagcgggggccgccggcgccgcatccctctctacctgccaacatcctgtattagagaacttgtggccggaggtgtggctgtggagagctggccggggagggacgctgctcagctgctgctctgctcctgtctcctgtcccctcccccggtcatgacagagacccgtgagccagctgagactgggggctacgccagcttggaagaagatgatgaagacctttccccaggccccgagcattcctctgattcagaatacactctctcagagccggactccgaagaggaagaagatgaggaggaggaggaagaggagaccactgacgatcctgaatatgatcctggctacaaggtgaagcagcgccttggcgggggccgtggtggcccatcccgccgggccccccgtgcagcccagcccccggcccagccttgccagctctgtggccgctcaccccttggggaggccccaccgggaaccccaccatacggggagcttggcagaaggggtggggtgggaggagggggctga

SEQ ID NO: 8716 - DNA, 5584 bp, Homo sapiens
tctccaactcgggaatccccggtgactttgtcgcagcctccgttaccctgtgatctgcaagtcctgggagacgcacagctaagatgcccggacatcctggaagctgggaaatgacagacccaacatacaggaggtgttgaccctcatacctggaacctggacatgtgtggaatttctaatctcattcctggactttcctgcaggtgatgtgactcttcttcagcctgcaccctgccaaaagaggattgtgatgtatcactggacccagcacctagatgacgtaactctcatcttttgcctggaccttgcatattttgggtgtgattgtgacacatacctctgctcagaatgtgagcgatttgactctcctgcctgggcccagtacacagatgggattgtgacatatcgctggacccagcatgtagatcatgtgaccctatactcttgccttggtgctgtcgcagagggcattgtgacatatcactggtccctgcacccagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctataatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatgaa

SEQ ID NO: 8717 - DNA, 1964 bp, Homo sapiens
aggcaacaaagactgcggttcctgttactcagcagcctcaaaaactcacaccagctcctgcaaggaatgtgaatcttggagctcccagctattctgttcctgtttctgtcagctccttccctgaaaactcagaggtgctcagcatgccatgctaaaaggcaaaataaaaagatcttggagacatctcagctttaatgaggactttccaacattccagactgccgtcctgcaatgaagctctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaagaacccactttccttatcaaccaagctgggcttctctctagtgactcctattctagcctttccccagaaacagagagtgttaatcctggtgaaaatataaagacagacactcagaaaaagagacctgggactgtgatactatcaaaactgtcaagtagaagaattatatcggaaagccagcttagcccccctgtgatcccggcccgcaggcctggattccgggtatgctatatctgtggccgagaatttgggtcccagtcaattgccattcatgaaccccagtgcttgcagaagtggcatattgaaaacagcaagttgcccaagcatttgaggaggccagaaccctccaaaccacagtctctcagcagcagtgggtcctacagtcttcaggcaactaacgaggctgcatttcagagtgcccaggctcagctgctgccctgtgaatcctgtggccgcacattcttgccagatcatcttcttgttcatcacagaagctgcaagccaaagggtgagggtcccagagcaccacactcaaacagttctgatcatcttactggcctcaagaaagcttgtagtggaaccccagcccgaccaaggactgttatctgctacatatgtggtaaggaatttggcaccctgtcccttcctattcatgagcccaaatgcctggaaaagtggaaaatggaaaatgaccggctccctgtggagctccaccagccactcccacagaagcctcagccccttccgaatgcacagtccagccaagcgggaccaaatcaagctcagcttgtgttctgcccacattgtagccgaatctttacctcagaccgcctcctggtacaccagagaagttgtaaaactcatccttatgggccaaaatatcagaatttgaatttagggagtaaaggaggcctaaaagagtacactaattccaagcagcaaaggaacagggcagcacccagtgtaactgataaggtaattcatgccacacaagacgcattaggtgaacctggtggtgccctctgcctgtaggggaacaagagaaaactatccccagaatcagccacctcagcccctagtattttttctatcaatgccttgtatcagcctcaaagcagcctgttcaagttaactccctgttgaactccagggcctatacctctcttggctgaatagatataagaacatccttgcctgatgggttcatattcctcttcaattctgctgtctaaaagaagaagagatggacttctttcttccctgatccctgatacaaataatccctgggagagacagtaatttgaaaatgagtcattaatgctgtgtctacattacagagatataattcccattccaacagccaatatttattgtcggtttattttagtcatctaccttaggaattcatttttggcaatgctgggttatgctgagtttatcttactaaaatagaatctgtgtcaaaaacccccaatgactttagcaacaattaaacactgaagcacttgcaaaaataca

SEQ ID NO: 8718 - DNA, 546 bp, Homo sapiens
acaccagctcctgcaaggaatgtgaatcttggagctcccagctattctgttcctgtttctgtcagctccttccctgaaaactcagaggtgctcagcatgccatgctaaaaggcaaaataaaaaggtaaagaacaaatgtcacaagatcttggagacatctcagctttaatgaggactttccaacattccagactgccgtcctgcaatgaagctctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaagaacccactttccttatcaaccaagctgggcttctctctagtgactcctattctagcctttccccagaaacagagagtgttaatcctggtgaaaatataaagacagacactcagaaaaagagacct

SEQ ID NO: 8719 - DNA, 572 bp, Homo sapiens
gctcctgcaaggaatgtgaatcttggagctcccagctattctgttcctgtttctgtcagctccttccctgaaaactcagaggtgctcagcatgccatgctaaaaggcaaaataaaaagagaatggaaaaatggcatcatgttgataaaaggtgatgccttccaggacattctgtaaatgtcctatgtgcagatatggtcaaaacgaataattcaggccaactgagtgaacatttctccagagatgcttgagatcttggagacatctcagctttaatgaggactttccaacattccagactgccgtcctgcaatgaagctctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaagaacccactttccttatcaaccaagctgggcttctctctagtgact

SEQ ID NO: 8720 - DNA, 7269 bp, Homo sapiens
ggagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcagatatcatctcttcttttgatcactgttcctgattgtgacattgtgcaagtgttaaattgtgtgccttttgttcctgaagaaagagatgtctcctactctttgtgttggataggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttatgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgttta

SEQ ID NO: 8721 - DNA, 2661 bp, Homo sapiens
gggaggtgacgtcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttgactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggagaaaaaccatatgcatgcaatgactgtggaaaagcctttagccacgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtagtgaatgtgggaagacctttggctatcgctcacacctgaatcaacatcagagaattcataccggagaaaagccctatgaatgcatcaaatgtgggaagttttttaggactgactcacaacttaatcgacatcatagaattcacactggagagagaccatttgaatgcagtaaatgtgggaaagccttcagtgatgctttagttctaattcaccataagagaagtcatgcaggagagaaaccctatgaatgtaacaaatgtggaaaggccttcagttgtggctcatatcttaatcaacatcaaagaattcatactggagagaaaccctatgaatgtagtgaatgtgggaaggcttttcatcagatcttgtccctaagactacaccagagaattcacgctggagaaaaaccttataaatgtaacgaatgtgggaataattttagctgtgtctcagcccttagacgacatcagagaattcataatagagaaacgctctgattataacaagtataggaaagaaaacatgtggttaccactcaatccttattaaatattagtgagttctttttggttagtaattctttgaatgtagttcatatttcagttcatgagtatccgttatttgaagtagctcagtagtagacatctgttacttttttttttttcagacagagtctcgctctgttgcccaggctggagtgcagtggtgtaatcttggctcactgcagcctctgcctcctgggttcaagcaatcctcctgcctcagcctcctgagtagctgggattacaggtgcctgccaccatacctggctaatttttgtatttttagtagagacggggtttcaccacattggtcaggctgatctcgaactcctgactttaggtgatccacacgcctcagacttcccaaagtgctgagattatagggatgagtcactgtgcacagctactaattgatttttgatctatgtatggcacctgatttcatcctcgagagtgacgtaaacctaagctactggttcattctctgtttatatagttaaacttcacttgtaatgttgataaaatcttttgtacccatgtgtttagcttcagtgtattttacaatctgatgtttctcctcacaatgaagtactaaattttgtttcttttcaactgtacaacccattgtcttgtgatatattgacctgatctcttaggattagtgaaaatttatgctttattaatatttgattgttattaggaccatctagagatttctgtttatgtgtgtgtatgtgcatctgaagatgtgtattttatttaaattttttgtattaagtg

SEQ ID NO: 8722 - DNA, 5126 bp, Homo sapiens
gaggattctgggaggtgacgtcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttggactctccatttctaagcccaacatgatctccttactggagcaagggaaggaaccgtggatggtggagagaaagatgtcacagggtcactgtgcagactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggagaaaaaccatatgcatgcaatgactgtggaaaagcctttagccacgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtagtgaatgtgggaagacctttggctatcgctcacacctgaatcaacatcagagaattcataccggagaaaagccctatgaatgcatcaaatgtgggaagttttttaggactgactcacaacttaatcgacatcatagaattcacactggagagagaccatttgaatgcagtaaatgtgggaaagccttcagtgatgctttagttctaattcaccataagagaagtcatgcaggagagaaaccctatgaatgtaacaaatgtggaaaggccttcagttgtggctcatatcttaatcaacatcaaagaattcatactggagagaaaccctatgaatgtagtgaatgtgggaaggcttttcatcagatcttgtccctaagactacaccagagaattcacgctggagaaaaaccttataaatgtaacgaatgtgggaataattttagctgtgtctcagcccttagacgacatcagagaattcataatagagaaacgctctgattataacaagtataggaaagaaaacatgtggttaccactcaatccttattaaatattagtgagttctttttggttagtaattctttgaatgtagttcatatttcagttcatgagtatccgttatttgaagtagctcagtagtagacatctgttacttttttttttttcagacagagtctcgctctgttgcccaggctggagtgcagtggtgtaatcttggctcactgcagcctctgcctcctgggttcaagcaatcctcctgcctcagcctcctgagtagctgggattacaggtgcctgccaccatacctggctaatttttgtatttttagtagagacggggtttcaccacattggtcaggctgatctcgaactcctgactttaggtgatccacacgcctcagactcccaaagtgctgggattatgggcgtgagccaccgcgcctggccacatctgttactttttgatctgttctatacctggcttagcccaccctcaatgcatatgattcagatgaaactgttaatcagggacagcagtggactggtcacaggctggccaattatttcccccaacctagtgataagggattggcaaatggccctgtctggatcaatgaagtcctttgcgggtattcctatgggcagtaagagaggttttattctggaactgcaagtttcaaggatttaataagattaaaaactcaccagtagcctttttgccactcatgaggaaagctttcccaaagagaaatctaacagaggaaaatggagatgagagacagaaatatgatgatacagcttgatctcctggatccagtcattcctgacagctacaccatcaccatcctttttcattttttgtgatccaataaatttcctttttttgcttaatttggattatatttttgcctcatggaattagagtgctgattcacacattctatgtttgctatacataaaagaaagccttaattttttacgtggcataattatttatcctgaggagcaaccttctgatataacaagtttatgaaagttgaatacacagccttcataaaactgagataattgttacattttatttgtcgataaaactattttagtgtttcttagtttttttcacattatggctgaatattttaaaattcaccaagtaaaattctttaacaggcttccccttaaggagttaaaatcatttgtcacagtgactcaccatttgcctgtaaagagagaatggaaagctaagagaataatactttcatttgtttaatgaatggctcttcatcttcaaggaattacttgattttcttctttcagtatgggtctaaacatattctgtggcagaatataataacaattaaattgtaaatgaggtcttttgtgggtgggctctaaatttggtttaagacccagtgcggtggctcacgcctgtaatccgagcactttgggaggccgaggtgggcagatcacctgaggtcaggagttcgagaccagcctgaccaacatggagaaaccccgtctctactaaaaatacaaaattagccgggtgtggtggtgcgtgcttgtaatcccagctactcaggagggtgaggcaggagaatcacttgaacctgggaagtggaggttacagtgagcgaagatcgcgccattgtactccagcctgggcaacaagagcgaaactccttctcaaaaaaaaaaaaaaaaaaaaaataaataaataaataaataaataaatttggtttaagaagtgtatggataacttctttgcagctagagatatcaaacaaagatattgctggcagaaagaatgagtcatttttaacaaatggtaaaagtaaagcagttaatgcctaaaatttttagagactaaatcatttccattattgggagtaatgaggaagatgaaggtgtagggcaatacgtttcttttttatctgagtggatatagggaaataaactggtgatatggcagctgggccatcttgaatagtgagaaccagtaagaatattgggtattgcctgaagagcatctgtaaaaacatatcagaacaaatgaaagaggaaagaatgaaggatttatatgtgtgcatagagtgaatatatgtgtgcatagagtgaaatattcaacttatacttatttctaataaaatctgaaaattatttttcataaatattcaaattccctttaaacagcttaaaatacagatttagtgactcagtacttcaaaccttgaatagaaacaaatatgattataaaatatttccaaacttatgttacatctaatctgaaacatattaatattataagcttaattcatgtcatcatttctttattttttattatatttcctggaggtataaggatatttatttttataatttccaagcactgagtaataatttatttcagaaagtttcagaaggttacagtaaactttaccaaacttgaagaagaatgactcagatcagtaagaagagtctgagttactcactaattgatttttattttatttatttattttttttgagacagggtctcactctgttatccaggctggaatgcggtgacacaatcatggctcactgcagcctcaacttcccaggctcaagcgaccctcccacctcagcctcctgagtagctgggactacaggtgtgctctaccacacctggctaagtttcgcgtttttctgtagagatggggtttcgcgagttgcccaggctggtctccaactcttggcctgaagtgatttgcccatctcggcttcccaaagtgctgagattatagggatgagtcactgtgcacagctactaattgatttttgatctatgtatggcacctgatttcatcctcgagagtgacgtaaacctaagctactggttcattctctgtttatatagttaaacttcacttgtaatgttgataaaatcttttgtacccatgtgtttagcttcagtgtattttacaatctgatgtttctcctcacaatgaagtactaaattttgtttcttttcaactgtacaacccattgtcttgtgatatattgacctgatctcttaggattagtgaaaatttatgctttattaatatttgattgttattaggaccatctagagatttctgtttatgtgtgtgtatgtgcatctgaagatgtgtattttatttaaattttttgtattaagtg

SEQ ID NO: 8723 - DNA, 4861 bp, Homo sapiens
acaggactctccatttctaagcccaacatgatctccttactggagcaagggaaggaaccgtggatggtggagagaaagatgtcacagggtcactgtgcagactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggagaaaaaccatatgcatgcaatgactgtggaaaagcctttagccacgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtagtgaatgtgggaagacctttggctatcgctcacacctgaatcaacatcagagaattcataccggagaaaagccctatgaatgcatcaaatgtgggaagttttttaggactgactcacaacttaatcgacatcatagaattcacactggagagagaccatttgaatgcagtaaatgtgggaaagccttcagtgatgctttagttctaattcaccataagagaagtcatgcaggagagaaaccctatgaatgtaacaaatgtggaaaggccttcagttgtggctcatatcttaatcaacatcaaagaattcatactggagagaaaccctatgaatgtagtgaatgtgggaaggcttttcatcagatcttgtccctaagactacaccagagaattcacgctggagaaaaaccttataaatgtaacgaatgtgggaataattttagctgtgtctcagcccttagacgacatcagagaattcataatagagaaacgctctgattataacaagtataggaaagaaaacatgtggttaccactcaatccttattaaatattagtgagttctttttggttagtaattctttgaatgtagttcatatttcagttcatgagtatccgttatttgaagtagctcagtagtagacatctgttacttttttttttttcagacagagtctcgctctgttgcccaggctggagtgcagtggtgtaatcttggctcactgcagcctctgcctcctgggttcaagcaatcctcctgcctcagcctcctgagtagctgggattacaggtgcctgccaccatacctggctaatttttgtatttttagtagagacggggtttcaccacattggtcaggctgatctcgaactcctgactttaggtgatccacacgcctcagactcccaaagtgctgggattatgggcgtgagccaccgcgcctggccacatctgttactttttgatctgttctatacctggcttagcccaccctcaatgcatatgattcagatgaaactgttaatcagggacagcagtggactggtcacaggctggccaattatttcccccaacctagtgataagggattggcaaatggccctgtctggatcaatgaagtcctttgcgggtattcctatgggcagtaagagaggttttattctggaactgcaagtttcaaggatttaataagattaaaaactcaccagtagcctttttgccactcatgaggaaagctttcccaaagagaaatctaacagaggaaaatggagatgagagacagaaatatgatgatacagcttgatctcctggatccagtcattcctgacagctacaccatcaccatcctttttcattttttgtgatccaataaatttcctttttttgcttaatttggattatatttttgcctcatggaattagagtgctgattcacacattctatgtttgctatacataaaagaaagccttaattttttacgtggcataattatttatcctgaggagcaaccttctgatataacaagtttatgaaagttgaatacacagccttcataaaactgagataattgttacattttatttgtcgataaaactattttagtgtttcttagtttttttcacattatggctgaatattttaaaattcaccaagtaaaattctttaacaggcttccccttaaggagttaaaatcatttgtcacagtgactcaccatttgcctgtaaagagagaatggaaagctaagagaataatactttcatttgtttaatgaatggctcttcatcttcaaggaattacttgattttcttctttcagtatgggtctaaacatattctgtggcagaatataataacaattaaattgtaaatgaggtcttttgtgggtgggctctaaatttggtttaagacccagtgcggtggctcacgcctgtaatccgagcactttgggaggccgaggtgggcagatcacctgaggtcaggagttcgagaccagcctgaccaacatggagaaaccccgtctctactaaaaatacaaaattagccgggtgtggtggtgcgtgcttgtaatcccagctactcaggagggtgaggcaggagaatcacttgaacctgggaagtggaggttacagtgagcgaagatcgcgccattgtactccagcctgggcaacaagagcgaaactccttctcaaaaaaaaaaaaaaaaaaaaaataaataaataaataaataaataaatttggtttaagaagtgtatggataacttctttgcagctagagatatcaaacaaagatattgctggcagaaagaatgagtcatttttaacaaatggtaaaagtaaagcagttaatgcctaaaatttttagagactaaatcatttccattattgggagtaatgaggaagatgaaggtgtagggcaatacgtttcttttttatctgagtggatatagggaaataaactggtgatatggcagctgggccatcttgaatagtgagaaccagtaagaatattgggtattgcctgaagagcatctgtaaaaacatatcagaacaaatgaaagaggaaagaatgaaggatttatatgtgtgcatagagtgaatatatgtgtgcatagagtgaaatattcaacttatacttatttctaataaaatctgaaaattatttttcataaatattcaaattccctttaaacagcttaaaatacagatttagtgactcagtacttcaaaccttgaatagaaacaaatatgattataaaatatttccaaacttatgttacatctaatctgaaacatattaatattataagcttaattcatgtcatcatttctttattttttattatatttcctggaggtataaggatatttatttttataatttccaagcactgagtaataatttatttcagaaagtttcagaaggttacagtaaactttaccaaacttgaagaagaatgactcagatcagtaagaagagtctgagttactcactaattgatttttattttatttatttattttttttgagacagggtctcactctgttatccaggctggaatgcggtgacacaatcatggctcactgcagcctcaacttcccaggctcaagcgaccctcccacctcagcctcctgagtagctgggactacaggtgtgctctaccacacctggctaagtttcgcgtttttctgtagagatggggtttcgcgagttgcccaggctggtctccaactcttggcctgaagtgatttgcccatctcggcttcccaaagtgctgagattatagggatgagtcactgtgcacagctactaattgatttttgatctatgtatggcacctgatttcatcctcgagagtgacgtaaacctaagctactggttcattctctgtttatatagttaaacttcacttgtaatgttgataaaatcttttgtacccatgtgtttagcttcagtgtattttacaatctgatgtttctcctcacaatgaagtactaaattttgtttcttttcaactgtacaacccattgtcttgtgatatattgacctgatctcttaggattagtgaaaatttatgctttattaatatttgattgttattaggaccatctagagatttctgtttatgtgtgtgtatgtgcatctgaagatgtgtattttatttaaattttttgtattaagtgcc

SEQ ID NO: 8724 - DNA, 5144 bp, Homo sapiens
gttgtggttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtgttctgcaagtgaaggccccctgaagtggaagacagcattggtactaatggccaactcaagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactggatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacttacaaggacctgaagtgggatatttcagtcaaatgaaaatcatctctgaaaatgtgcccagttacaaaactcatgaatctcttactttacctcggagaactcatgacagtgagaagccctatgaatacaaggaatatgagaaggtcttcagttgtgacttagagtttgatgaatatcagaaaatacatactggtggaaaaaactatgaatgtaatcaatgttggaaaacctttgggatagataactccagtatgttacaactgaatattcatactggtgtgaaaccttgtaaatatatggaatatgggaatacatgtagtttttataaagactttaatgtataccagaaaattcataatgagaagttctataaatgtaaggaatacagaaggacctttgaaagagttggaaaagttactccacttcaaagagttcatgatggtgagaaacactttgaatgctcattctgtgggaaatcctttagagtgcatgcacaacttactcgacatcagaaaatccatactgatgagaaaacttacaaatgtatggaatgtggcaaggacttcagatttcattcacagcttaccgaacatcagagaattcatactggtgagaaaccctacaaatgtatgcactgtgagaaggtttttagaattagttcacagctcattgaacatcagagaattcacactggtgagaaaccttatgcatgtaaggaatgtgggaaggcttttggagtatgtagagaacttgctcgtcatcagagaattcatactggtaagaaaccctatgaatgcaaagcatgtggaaaggtctttagaaatagttcatccctgactagacatcagaggattcatactggtgaaaaaccctataaatgtaaagaatgtgagaaagcatttggagtaggtagtgaacttactcgacatgaaagaattcacagtggtcaaaaaccttatgaatgtaaggagtgtggaaagttctttagacttacgtcagcccttattcaacatcaaagaattcatagtggtgagaaaccttatgaatgtaaggtatgtgggaaggcctttagacatagttcagcccttacagaacatcagagaattcatactggagaaaaaccctatgaatgcaaggcatgtgggaaggcctttagacatagttcatcctttaccaaacatcagcgcattcatactgatgataaaccctatgaatgtaaggagtgtgggaattcctttagtgttgttgggcatcttacttgccaaccgaaaatttacactggtgagaaatcatttgactgaaataaatgtataaagtggttttttatttctgattttcacaggaaaatactgtggatggatttaataggtaatcaaggcaattcagtatctccctctcttaaagtctgtttttagacttcatggtcattctgtatgtagacgtagaattgcttagtcatagctgatatatacttatagctttgttagatgttgccaaatatttctcctttttatgttaaaaagtttttttcatgagtttctcatcctggcatgttttgtttacaatagcttttgatgtttgtattattgctcttttgactattcagttttttaattgtaatattacttcaatatcttttctgcattgtaattctttgcttgtgatatctatacttacttattttcctccacagagttagcactcctagtcagatacaatgtatttttacagtcttacagctcatcattttgtgtaatgttgttttgttttgttttaaatgatagaagtgtgatctcctttccattttcatccaattgttgacttctctttaaatttctactttattttgatacaacatattccccccaaaaaaacacatacataggaactggttatattccaccataacacacacacacacacacacacactatatacatatagtgtatatacacatatagtgtatatagtgtatgtgtgatgtatactatacatatcacatatactatatgtgtgtatatagtgtgtgatgtatatgtgtgtgatgtatactatatatgcccacacatgcactacataacacactatatatatatatatatatacacacacacacacacaatatatgtatatatagtatatacactatatactgggcactatatatatatagtgtgtatgtgtgttatattggaatataaccagttcctttaagcagtctttttacctgcaggctataccaaccaggatccaaatgaagagaactcttttaaatatttgataaaactactcacccagtaagtctcttaaaatttatcattctcttaaagtatcactctaaaatttgtcaaacacctttaaaaggggagaaaaaatgaccactgaacttacattaagagaatttacaactatatattaacatggcttcaattgtttttttaatctattatcattatttttctttttattccctctcagagttgacttactaggtttgggcatttcaacaatcagcagaccttctttggtttaactaatctcatttaactccaaaatcatctctctcttaggactgctgacttggttatgcagtcaatgagatcacgagccactggttattggattttttttctttttttttagacagagttttgctcttgttgcctaggctggagtgcagtggcgcagtcttggctcacctcaacctctgcctcccaggttcaggctattctcctgctcagcctcctgattagctgggattacaggcatgcgccaccatgaccggctaattttatatttttagtagagacgggatatctccgtgttggtcagtctggtctcaaactcccgacctcaggtgatccacccgcctcagcctcccaaagtgctgggattacaggcatgagccaccgcacccagcctggttattggatttatttatttattttgagatagagccttgctctgtcaccaggccggagtgcagtggtgtcatctcagatcactgcaacctccacctcccaggttcaagcgattcccctgcctcagcctgccaagtagctgggattacaggcatgcgccaccatgcccagctaattgtattttagtagatatggagtttcaccacgttggccaagacagtctcgatttcctgaccttgtgatccccctgcctcggcctcccaaagtgctgggattacaggcatgagccaccacgcctgtccggttatttgatttttataagaaaattttactattattttcagataaatttatgtcactgtcattcattacattttaatttttgaaactgatgtctttcccagaatttatgtactctataacggtgtgaatgattaccagtattaagccattttctcatctgatatattgagctatgttttatgtaagtattgcttattcaagtagttttaaaagatatgtaattggttgttgtttcatgtcctacacagtaagaacaagagtatgttaacctttttgtcaggatatttgctatttcatatctttgaaatagagtagtagctctatttctaactaaattctatttatgtaacaacacagctaatttactcttggatctcattctccctttttatcctgagttaccatcagtgctaatgttcctcttttgggtatagttctccaggagaacttgtcctatatttctttgtgtgtgtttttttccttccagcttaaacaaattaaaactaaatatctaaaccttgtatacagacattaaaattagtgagagaaacaaaatatccttgtgtcttggcttttactttttgaagtcattaacaaataataaattaatgaataaaatgtgtccttattatgttttccttgtttgtagttacagctatatttttatcatattaacatttttcacttaacttcgtaatgaacttatggcatttcacacttactcgaaaccataatataattattattggtggtattactgtttggtttttactatttttactcaaaaacataaaacttcaccattctttccattttcatttgcccctttattctttctgacttttctctaagcctgcataggagctttattctcatattcaataggataggatattgcagtctcatcctgttttctgctgtcctgcaccattaaattttatatgtccttgaaggaattcaatttaatggcaactaatatatgtatgttagggacaggtaaagagtctgtgactgagatttctggagttatataacccctgcgccaccccccaccccaactccaacttgccagaattcaccccttaacctgcaatgtgattgtatttggacatagggcaatgaggacataagaatgtgattctaatttgatacaaatggtgatcttatgagaagaggaaggagagacgtctcttcctatgctcacacacaaaggaaagtccacatgaggacacaaggagaagccaagagagcccttaccaggaattaaacctgctaatccctattttaattagaacagtgagaaaataaatatctgtatttaagcctc

SEQ ID NO: 8725 - DNA, 4331 bp, Homo sapiens
gccgggctgcgggaggagctcgcggtgaggtggccccgcgctgccgggcgaggtcggtccacgtggagccgggagcctgaggcctctgtacgcgggagctgcggacgatggtgttctgcaagtgaaggccccctgaagtggaagacagcattggtactaatggccaactcaagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactggatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacttacaaggacctgaagtgggatatttcagtcaaatgaaaatcatctctgaaaatgtgcccagttacaaaactcatgaatctcttactttacctcggagaactcatgacagtgagaagccctatgaatacaaggaatatgagaaggtcttcagttgtgacttagagtttgatgaatatcagaaaatacatactggtggaaaaaactatgaatgtaatcaatgttggaaaacctttgggatagataactccagtatgttacaactgaatattcatactggtgtgaaaccttgtaaatatatggaatatgggaatacatgtagtttttataaagactttaatgtataccagaaaattcataatgagaagttctataaatgtaaggaatacagaaggacctttgaaagagttggaaaagttactccacttcaaagagttcatgatggtgagaaacactttgaatgctcattctgtgggaaatcctttagagtgcatgcacaacttactcgacatcagaaaatccatactgatgagaaaacttacaaatgtatggaatgtggcaaggacttcagatttcattcacagcttaccgaacatcagagaattcatactggtgagaaaccctacaaatgtatgcactgtgagaaggtttttagaattagttcacagctcattgaacatcagagaattcacactggtgagaaaccttatgcatgtaaggaatgtgggaaggcttttggagtatgtagagaacttgctcgtcatcagagaattcatactggtaagaaaccctatgaatgcaaagcatgtggaaaggtctttagaaatagttcatccctgactagacatcagaggattcatactggtgaaaaaccctataaatgtaaagaatgtgagaaagcatttggagtaggtagtgaacttactcgacatgaaagaattcacagtggtcaaaaaccttatgaatgtaaggagtgtggaaagttctttagacttacgtcagcccttattcaacatcaaagaattcatagtggtgagaaaccttatgaatgtaaggtatgtgggaaggcctttagacatagttcagcccttacagaacatcagagaattcatactggagaaaaaccctatgaatgcaaggcatgtgggaaggcctttagacatagttcatcctttaccaaacatcagcgcattcatactgatgataaaccctatgaatgtaaggagtgtgggaattcctttagtgttgttgggcatcttacttgccaaccgaaaatttacactggtgagaaatcatttgactgaaataaatgtataaagtggttttttatttctgattttcacaggaaaatactgtggatggatttaataggtaatcaaggcaattcagtatctccctctcttaaagtctgtttttagacttcatggtcattctgtatgtagacgtagaattgcttagtcatagctgatatatacttatagctttgttagatgttgccaaatatttctcctttttatgttaaaaagtttttttcatgagtttctcatcctggcatgttttgtttacaatagcttttgatgtttgtattattgctcttttgactattcagttttttaattgtaatattacttcaatatcttttctgcattgtaattctttgcttgtgatatctatacttacttattttcctccacagagttagcactcctagtcagatacaatgtatttttacagtcttacagctcatcattttgtgtaatgttgttttgttttgttttaaatgatagaagtgtgatctcctttccattttcatccaattgttgacttctctttaaatttctactttattttgatacaacatattccccccaaaaaaacacatacataggaactggttatattccaccataacacacacacacacacacacacactatatacatatagtgtatatacacatatagtgtatatagtgtatgtgtgatgtatactatacatatcacatatactatatgtgtgtatatagtgtgtgatgtatatgtgtgtgatgtatactatatatgcccacacatgcactacataacacactatatatatatatatatatacacacacacacacacaatatatgtatatatagtatatacactatatactgggcactatatatatatagtgtgtatgtgtgttatattggaatataaccagttcctttaagcagtctttttacctgcaggctataccaaccaggatccaaatgaagagaactcttttaaatatttgataaaactactcacccagtaagtctcttaaaatttatcattctcttaaagtatcactctaaaatttgtcaaacacctttaaaaggggagaaaaaatgaccactgaacttacattaagagaatttacaactatatattaacatggcttcaattgtttttttaatctattatcattatttttctttttattccctctcagagttgacttactaggtttgggcatttcaacaatcagcagaccttctttggtttaactaatctcatttaactccaaaatcatctctctcttaggactgctgacttggttatgcagtcaatgagatcacgagccactggttattggattttttttctttttttttagacagagttttgctcttgttgcctaggctggagtgcagtggcgcagtcttggctcacctcaacctctgcctcccaggttcaggctattctcctgctcagcctcctgattagctgggattacaggcatgcgccaccatgaccggctaattttatatttttagtagagacgggatatctccgtgttggtcagtctggtctcaaactcccgacctcaggtgatccacccgcctcagcctcccaaagtgctgggattacaggcatgagccaccgcacccagcctggttattggatttatttatttattttgagatagagccttgctctgtcaccaggccggagtgcagtggtgtcatctcagatcactgcaacctccacctcccaggttcaagcgattcccctgcctcagcctgccaagtagctgggattacaggcatgcgccaccatgcccagctaattgtattttagtagatatggagtttcaccacgttggccaagacagtctcgatttcctgaccttgtgatccccctgcctcggcctcccaaagtgctgggattacaggcatgagccaccacgcctgtccggttatttgatttttataagaaaattttactattattttcagataaatttatgtcactgtcattcattacattttaatttttgaaactgatgtctttcccagaatttatgtactctataacggtgtgaatgattaccagtattaagccattttctcatctgatatattgagctatgttttatgtaagtattgcttattcaagtagttttaaaagatatgtaattggttgttgtttcatgtcctacacagtaagaacaagagtatgttaacctttttgtcaggatatttgctatttcatatctttgaaatagagtagtagctctatttctaactaaattctatttatgtaacaacacagctaatttactcttggatctcattctccctttttatcctgagttaccatcagtgctaatgttcctcttttgggtatagttctccaggagaacttgtcctatatttctttgtgtgtgtttttttccttccagcttaaacaaattaaaactaaatatctaaaccttgtatacagacattaaaattagtgagagaaacaaaata

SEQ ID NO: 8726 - DNA, 3014 bp, Homo sapiens
caggtggccctgaattcattgcctgctcagcaaaataaaggcccagtgtggaagccggaacttgcatttgaagaaggatgggaaggatgggttgaggagggcccatccccagcagcccgagagggaggaggccacggagacttggagcattcccgtttcttccagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactgcaggaacttctggaggaaagcactcattgatctttcatccctaagatagtttgagagagctcacactggatatataagttatttgttgcagcataacaaatgatccccgcaaattttgtggcttcaaacacgaaatgtttattctctaacaatttctacagatcaggaattcaagaacagcttatctctgtagttacactgcaggatctctcatgcctttacttacaatcaagatgtcagccaaagctatagtcatctaacatctttactgatgaacagtccacttccaagatgacttattcacatgcctggaaagttgatgttggttgttgtcaggggaccttcagtcattaccatgtaggcctctttacaaggcccagctccttgacaatttggcaataagttctcgccaaggttagtgatccaagagaggaccaatacagaggccaaaatggcttttatgacctatcctcaggaggactgctaagctttcacttatttcctattgtgttggtctcacaacacaccaatcctgatacaatgtgagagactgcagaaggtatgaataccaggaaacagataactcagaagcatctgggaaatttgccatggaattaatgaagaaaagccctcagcacatcatccttctactctaatcaatatgaaatagcattcagtaactcctattaattcactctgaagagaaaccttttgaggacaatctgtatggtaaagctctcagctcgaattctcaccttcatgggcccagaagattatgtactgagagaatcctgaagaatggaacagctgtagaaagccttcagtgctatcagcagggattcatgtgacagctcacactaagggagaaaacctgtgaaggtctcagaaggcttcagtgacagtcatcccttaagacgcactggaaatcacacaatggaacaacactcagaaatgcggaataccctacagcaaaagtgttcacattactgagcaaactatagtgtggtattctgcagtgactatgggaaagccttgaatgttctatcggtttttaagggacttgagaattaattctggagagaatgccccattgaacatcatcaatattggagagctttctgtttttctacatttgttaggaaacttgtgagcattcacactacagagaaacttgaaatataaagaagaagagaaagccttcagtgatgcctctgtgttagggaaaatatggaacttctccctggatgcaaaacctatgagtatattaatattggaaaatttttcagtgattcttctctttcttgtatatgagagaacttatatggagaaacccctaggaatgtaatcagtgttaggatgcctcagcctgaactcttcactgagtggccacaattttcactgggaacaaaaagtataatcactgttttgagtgtgggatatcctttatcagtgtctcatctgtagattggactgctggctcattaatttttttagtctttttttcttttaatataaacatttgtgtatagctgttccctaaaataaacattaacatatttcataatttt

SEQ ID NO: 8727 - DNA, 2427 bp, Homo sapiens
ccaaagaatttcttgtaggcctgaaacacatactcctaataactatgggaataattttttccattcatcattactcacacaaaaacaggaagtacacatgagagaaaaatctttccaatgtaatgagactggcgaagcctttaattgtagctcatttgtaaggaaacatcagataatccatttaggagaaaaacaatataaatttgatatatgtggcaaagtctttaatgagaagcgataccttgcacgccatcgtagatgtcacactagtgagaaaccttacaagtgtaatgaatgtggaaagtccttcagttacaagtcatccctgacatgccatcgtagatgtcacactggtgagaaaccttacaagtgtaatgaatgtggaaagtccttcagttacaagtcatcccttacatgccatcataggtgtcacactggtgagaaaccttacaagtgtaatgaatgtggaaagtccttcagttacaagtcatcccttagatgccatcgtagacttcatactggaataaaaccttacaagtgtaatgagtgtggcaagatgtttggtcaaaattcaacccttgtaattcataaggcaattcatactggagagaaaccttacaagtgtaatgaatgtggcaaggcttttaatcaacaatcacacctttcacgtcatcatagacttcatactggagagaaaccttacaagtgtaatgactgtggtaaggcttttattcatcagtcaagccttgcacgtcatcatagacttcatactggagagaaatcttacaaatgtgaagaatgtgacagagttttcagtcagaaatcaaaccttgagagacacaagataattcatactggagagaaaccttacaagtgtaatgagtgtcacaagaccttcagtcacaggtcatctcttccatgccatcgtagacttcatagtggtgagaaaccttacaagtgtaatgaatgtgggaagacttttaatgtacagtcacacctttcacgtcatcatagacttcatactggagagaaaccttacaaatgtaaggtttgtgacaaggctttcatgtgccattcttatctggcaaaccatactagaattcatagcggagagaaaccttacaagtgtaatgagtgtggtaaggctcacaatcacttgattgattcatcaatcaagccttgcatgtcatcatagacttcatactggagagaaaccttacaaatgtgaagcatgtgacaaagttttcagtcacagatcacgccttaaaagacataggagaattcatactggagagaaaccttacaagtgtaatgagtgtggcaaagcctttagtgaccagtcaacacttaccatcaggccattcatggtgtagggaaacttgactaatgtaatgattgtcacaaagtcttcagtaacgctacaacgattgcaaatcattggagaatccataatgaagagagatcttccgagtgtaataaatgtggcaaatttttcagacatcgttcataccttgcagttcatcagtgaactcatactggagagaaaccttacaaatgtcatgactgtggcaaggtcttcagtcaagcttcatcctatgcaaaacataggagaattcatgcaggagagaaatgtcacaagtgtgatgagtgttgcaaagcctttacttcatgttcacacctcattagacatcagagaatccctactggagagaaatcttacaaatgtcatcagtgtggcaaggtcttcagtccgaggtcactccttgcagaacatcagaaaattcatttttgagataactgttcccaatgcagtgagtatagcaaaccatcaagcattaattgacattggagtcaattcagcattgacttgagtttgtgttgacttaacattgagttcaagccttaattgacatgcaggtgtttatgataagaggattgggccaggtgcagtggatcacgcctgtaatcccagcacattgggaggccaaggcacataggtcacttgaggtcaagagtttgaaacaagcatggccaagagatgtgagccagttttcccagcctgtttattattattttttgagatggagtgttgctcttgctgcccaggctagagtgcaatggtgcgatcttgactcacagcaacctccgcctcctgggttcaagcgattcctctgcctcagcactttgggaggccaaggcaggcagataacaaagtcaggagattgagaccgtcctggctaacacggtgaaacctcgtctctactaaaaatacaaaaacttagccgggcatggtggtgggcacctgtagtctcagctactcagggggctgaggctggacaatggtgtgaacccaggaggcggtgcttgcagggagccgagatcgtgccactgcactccaggctgggcgacagagtgagagtctgtctc

SEQ ID NO: 8728 - DNA, 6741 bp, Homo sapiens
gatcgcgtggggagccggtcttggagcagcgggattagcttctaaagtctctttcatctctcctaaggaagaagcctagaagaggaggaagaggaaagaaaaggagtcaggaatgcctcttagatatctcttccaaatgcatgatgaaaaaggtgggaagattacttgagccagggagttgaaggctgcagtgagccctgtttttgccaccacactccagcttgggattgatttctaaagactcatgttacatgaggaagcagctcagaagaggaaaggaaaggagccaggcatggctcttcctcagggacgcttgactttcagggatgtggctatagaattctcattggcagagtggaaattcctgaaccctgcgcagagggctttgtacagggaagtgatgttggagaactacaggaacctggaggctgtggatatctcttccaaacgcatgatgaaggaggtcttgtcaacagggcaaggcaatacagaagtgatccacacagggatgttgcaaagacatgaaagttatcacactggagatttttgcttccaggaaattgaaaaagatattcatgactttgagtttcagtcacaaaaagatgaaagaaatggccatgaagcatccatgccaaaaatcaaagagttgatgggtagcacagaccgacatgatcaaaggcatgctggaaacaagcctattaaagatcagcttggattaagctttcatttgcatcttcctgaactccacatatttcagcccgaagagaaaattgctaatcaagtggagaagtctgtcaacgatgcttcctcaatttcaacatcccaaagaatttcttgtaggcctgaaacacatactcctaataactatgggaataattttttccattcatcattactcacacaaaaacaggaagtacacatgagagaaaaatctttccaatgtaatgagactggcgaagcctttaattgtagctcatttgtaaggaaacatcagataatccatttaggagaaaaacaatataaatttgatatatgtggcaaagtctttaatgagaagcgataccttgcacgccatcgtagatgtcacactagtgagaaaccttacaagtgtaatgaatgtggaaagtccttcagttacaagtcatccctgacatgccatcgtagatgtcacactggtgagaaaccttacaagtgtaatgaatgtggaaagtccttcagttacaagtcatcccttacatgccatcataggtgtcacactggtgagaaaccttacaagtgtaatgaatgtggaaagtccttcagttacaagtcatcccttagatgccatcgtagacttcatactggaataaaaccttacaagtgtaatgagtgtggcaagatgtttggtcaaaattcaacccttgtaattcataaggcaattcatactggagagaaaccttacaagtgtaatgaatgtggcaaggcttttaatcaacaatcacacctttcacgtcatcatagacttcatactggagagaaaccttacaagtgtaatgactgtggtaaggcttttattcatcagtcaagccttgcacgtcatcatagacttcatactggagagaaatcttacaaatgtgaagaatgtgacagagttttcagtcagaaatcaaaccttgagagacacaagataattcatactggagagaaaccttacaagtgtaatgagtgtcacaagaccttcagtcacaggtcatctcttccatgccatcgtagacttcatagtggtgagaaaccttacaagtgtaatgaatgtgggaagacttttaatgtacagtcacacctttcacgtcatcatagacttcatactggagagaaaccttacaaatgtaaggtttgtgacaaggctttcatgtgccattcttatctggcaaaccatactagaattcatagcggagagaaaccttacaagtgtaatgagtgtggtaaggctcacaatcacttgattgattcatcaatcaagccttgcatgtcatcatagacttcatactggagagaaaccttacaaatgtgaagcatgtgacaaagttttcagtcacagatcacgccttaaaagacataggagaattcatactggagagaaaccttacaagtgtaatgagtgtggcaaagcctttagtgaccagtcaacacttaccatcaggccattcatggtgtagggaaacttgactaatgtaatgattgtcacaaagtcttcagtaacgctacaacgattgcaaatcattggagaatccataatgaagagagatcttccgagtgtaataaatgtggcaaatttttcagacatcgttcataccttgcagttcatcagtgaactcatactggagagaaaccttacaaatgtcatgactgtggcaaggtcttcagtcaagcttcatcctatgcaaaacataggagaattcatgcaggagagaaatgtcacaagtgtgatgagtgttgcaaagcctttacttcatgttcacacctcattagacatcagagaatccctactggagagaaatcttacaaatgtcatcagtgtggcaaggtcttcagtccgaggtcactccttgcagaacatcagaaaattcatttttgagataactgttcccaatgcagtgagtatagcaaaccatcaagcattaattgacattggagtcaattcagcattgacttgagtttgtgttgacttaacattgagttcaagccttaattgacatgcaggtgtttatgataagaggattgggccaggtgcagtggatcacgcctgtaatcccagcacattgggaggccaaggcacataggtcacttgaggtcaagagtttgaaacaagcatggccaagagatgtgagccagttttcccagcctgtttattattattttttgagatggagtgttgctcttgctgcccaggctagagtgcaatggtgcgatcttgactcacagcaacctccgcctcctgggttcaagcgattcctctgcctcagcctccctagttgctgggattacaggtatatgccacgacgcctggctaattttttgtatttttagtagggaaagggtttctccatgttggtcaggctggtctcaaactcccgatctcaggtgatccgcccacctcagcctcccaaagtgatgagattacaggcatatgccaccgcgcctggcattgtttcttcttttccttttttttttttttttttttttttgagatagtactttttaaagagatagtacttttttgagatagtacttttttaaagggatataccatagtagttttaaaagggatatcaggctgggtgtggcagctcacgccggtaatcccagcactttgggaggccaaggcaggcagataacaaagtcaggagattgagaccgtcctggctaacacggtgaaacctcgtctctactaaaaatacaaaaacttagccgggcatggtggtgggcacctgtagtctcagctactcagggggctgaggctggacaatggtgtgaacccaggaggcggtgcttgcagggagccgagatcgtgccactgcactccaggctgggcgacagagtgagagtctgtctcaaaaaaaaaaaaaaaaagatatcaaacccggggtgtctcatcccacagcactttggaagactgaagtgagtggatcatctaagatcagagttcaagagcaccctggctaacatggtgaaaccccatctctactaaaaatacaaaagttagccaggggtgggggtgtgcacctttagttccagctacttgggacactgaggcatgagaatcacttaaacctgggaggtagaggttacagcgaatcaaaaccgtgccactgtactgcagcgaggttggcagagtgagtctccatctcaaacaaacaaatgaaaaaaacagacatcaaaaatgcttttgttctcgttgtgtcatagacttcccttttttttccttctggttcctcttcagttctctatttattttttcttttttgcagattgagtttgagatatatcttagttttaatagttttatttcttaacacataatgacttctgaaagatgcctttgcagcatcctgtaatcagctcacatcattcgtttctgtacttgtatattttccagttgttttccggttgaccccaaaattcgtgagatttttttcctacaacaatttcaaaagagttgctgtttgaaattagttgcatccagttcagatcgaggtctgcatgctttctagtctttgttatttattggaaggctgtggtacctactacttaagtttgattgttgcagtgtgtacttggtaaagatgtcagtgaccttttaaataaacatcaaaatgtagtttaagcagttagtctgtttttcagttttctttccttatgtcattttttaaaatcttgagctgggagctatttattgtgtgtttccctcaaggccctgtggtccattctggaaaaatgttgaaacatgggctggagtggcatagagcgctgctccaaaagcacccatgtattcttttcttttttggaaatggagtctcgctctgtcagcttggatggagtgcagtggtgcgatctcagctcactgcaacctctacctccttggatcaagtgatgctcctgcctcagtctcctgaggagctggaattacaggcacccaccagcacacccagctagtttttgtatttttagtagagacagggtttcaccatgtttgtcaggctggtctcaaactcctgacctcgcgatccacccgactcagcctcccactgtgatgggattacaggcatgagctaccacgtcgagactcttttttttttttttttttagatggagttttgcttttgttgctgaggctggagtgcaatggtgcgatctggtgtcactccaatgtcttcctcctgggttcaagtgatttctcctgcctcatcctactgagtagttgggattacaggtgccctccaccactcccggctcattttttgcatttttagtagagacagggtttcatcatgttggcaggctggtcttgaactcctgacttcaggtgatctgcccacctcgacctcccaaaatgctaggattacaagcgtgagccattgtgcctgaccactcatgtattcttgattgaaataatttgcttatttcttagttctacagctgaccctctttcactgtttccaaggtcaatagctgtgtgttcacacttctgcattttataaatgttcctgtgagttttttgtaaggaagaattaactgtcaggaatcaatgtcatcagaaccttgcaaaagaagtttctttagcccaggtttgtgaaagaggtttctctaattttcaaggatgggggtgataagagcaacctttgccattagcccttccaggaccccatgtaagactttagacaccttctcactcatctcagaccttctcagggtaacttggtgaaaatgtcttccgatctgagccccagtgagcctccctgcaacttggcgacgaggggcttgaccagaaaaggtcaacccgagtgtccctgaccgttgaaatgattggcaaaatggagtgcgtgtctgggtgtggcttttttttttttgaggagtgcccagttgtgattagaattttcaatgggatgcagtgccctaaaaatgaaaaacaaaagcagaagaatggaagaaatagaggtagactcagacacagagaccatcttcaaggcctttctctgtatgaggacatcacagcaaaatctaaagcaggtcacgtcaatccctggcagggaaccctccaccggcttcccgtgttccccaggacaaaagcccaacccctcactgtggctccacagccccgtgtgcagggcccctgccagtgtccagcctcctcctggcagcttgccctcatctcatgactccctctgccccagtcacatttgcttttctcttttcccaaacatcaaaacccttcctgtctcaggtcattgtccctgctcttaccctatgtaccctgtccctttctcctccttcaggtctaggctcagagctctctcccatgccctcccacccctggtctcaagctcctgagctcaagtgatctacccacctcggcctcctagagtgctgggatgacaggcatgagccactgcaaccagcctctgcatggggtttcctcaactttaggtctgtgccctgaaggggagctcattccagcccagttcccaactgctgcagcatgtgtgtgtgggcttctccagaaggggagccagagtttccctgtaggagtttatcctccatggtgaggagggccgcaggggggactgtatttgctcagggtgaggtctcctttgtgtcaggcctctgagcccaagctaagccatcgtatcccctgtcacctgcacgtatacatccagatggcctgaagcaactgaagatccacgaaagaagtgaaaatacccttaagtgatgacattccaccattgtgatttatttctgcaccatcttgactgatcaatgtgctttgtaatctcccccacccttcagaaggctctttgtaatcctccccacccttgagaatggacttggtgagatccaccccctgcctgcaaagcattgcccctaactccaccgcctgtcccaaaagctacaagaactaatgataatcccaccatactttgctgactctcttttcacactcagcccgcctgcacccaggtgaaataaacagcctcgttgctcaca

SEQ ID NO: 8729 - DNA, 2017 bp, Homo sapiens
gatcgcgtggggagccggtcttggagcagcgggattagcttctaaagtctctttcatctctcctaaggaagaagcctagaagaggaggaagaggaaagaaaaggagtcaggaatgcctcttagatatctcttccaaatgcatgatgaaaaaggtgggaagattacttgagccagggagttgaaggctgcagtgagccctgtttttgccaccacactccagcttgggattgatttctaaagactcatgttacatgaggaagcagctcagaagaggaaaggaaaggagccaggcatggctcttcctcagggacgcttgactttcagggatgtggctatagaattctcattggcagagtggaaattcctgaaccctgcgcagagggctttgtacagggaagtgatgttggagaactacaggaacctggaggctgtggatatctcttccaaacgcatgatgaaggaggtcttgtcaacagggcaaggcaatacagaagtgatccacacagggatgttgcaaagacatgaaagttatcacactggagatttttgcttccaggaaattgaaaaagatattcatgactttgagtttcagtcacaaaaagatgaaagaaatggccatgaagcatccatgccaaaaatcaaagagttgatgggtagcacagaccgacatgatcaaaggcatgctggaaacaagcctattaaagatcagcttggattaagctttcatttgcatcttcctgaactccacatatttcagcccgaagagaaaattgctaatcaagtggagaagtctgtcaacgatgcttcctcaatttcaacatcccaaagaatttcttgtaggcctgaaacacatactcctaataactatgggaataattttttccattcatcattactcacacaaaaacaggaagtacacatgagagaaaaatctttccaatgtaatgagactggcgaagcctttaattgtagctcatttgtaaggaaacatcagataatccatttaggagaaaaacaatataaatttgatatatgtggcaaagtctttaatgagaagcgataccttgcacgccatcgtagatgtcacactagtgagaaaccttacaagtgtaatgaatgtggaaagtccttcagttacaagtcatccctgacatgccatcgtagatgtcacactggtgagaaaccttacaagtgtaatgaatgtggaaagtccttcagttacaagtcatcccttacatgccatcataggtgtcacactggtgagaaaccttacaagtgtaatgaatgtggaaagtccttcagttacaagtcatcccttagatgccatcgtagacttcatactggaataaaaccttacaagtgtaatgagtgtggcaagatgtttggtcaaaattcaacccttgtaattcataaggcaattcatactggagagaaaccttacaagtgtaatgaatgtggcaaggcttttaatcaacaatcacacctttcacgtcatcatagacttcatactggagagaaaccttacaagtgtaatgactgtggtaaggcttttattcatcagtcaagccttgcacgtcatcatagacttcatactggagagaaatcttacaaatgtgaagaatgtgacagagttttcagtcagaaatcaaaccttgagagacacaagataattcatactggagagaaaccttacaagtgtaatgagtgtcacaagaccttcagtcacaggtcatctcttccatgccatcgtagacttcatagtggtgagaaaccttacaagtgtaatgaatgtgggaagacttttaatgtacagtcacacctttcacgtcatcatagacttcatactggagagaaaccttacaaatgtaaggtttgtgacaaggctttcatgtgccattcttatctggcaaaccatactagaattcatagcggagagaaaccttacaagtgtaatgagtgtggtaaggctcacaatcacttgattgattcatcaatcaagccttgcatgtcatcatag

SEQ ID NO: 8730 - DNA, 452 bp, Homo sapiens
gcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggaactcgtaacattcagggatgtggccatagaattctcccctgaagagtggaaatgtctggaccctgcccagcagaatttgtatagagatgtgatgttggagaactacaggaacctggtctccctgggttttgtgatctctaacccagacctggtcacctgtctggagcaaataaaagagccctgcaatttgaagatacatgagacagcagccaaacccccaggtagtgatctccaagtttacaaggagagccaatgtccactttatcgcttataa

SEQ ID NO: 8731 - DNA, 3195 bp, Homo sapiens
gccggatcccggaccatggcggcggccgggggcgccgaggggcggcgcgcggacatggaggcggaggcggcggcagctcctgagcgggaaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacatggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcatgcttcaagaatgttcaggattaaaagcagacaagaaattgtg

SEQ ID NO: 8732 - DNA, 3371 bp, Homo sapiens
ccggaaggggcgggcccgccgggagccaggccgctcggcgccacgaccggccgagaggggggccggatcccggaccatggcggcggccggggggcgccgaggggcggcgcgcggacatggaggcggaggcggcggcagctcctgagcgggaaggcgggagctgcgtgctgtgctgcggagacctggaggccacggcgctggggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacatggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcatgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgca

SEQ ID NO: 8733 - DNA, 5958 bp, Homo sapiens
aaaaggtgattatccttgtgttgttgataaagggattttctttttagctaccgtaagatgcttactgtcataggtttatttttcgggtttggttattttcctttaaacctgatattggactgtgaggacaatacatgagccaccttactctccatccttccctgtcccctttactgattccccaatactaatcgttttttattctggtaacacccagacaagaaatattcgacttttcccccccccttcacaggaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaccaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaat

SEQ ID NO: 8734 - DNA, 4726 bp, Homo sapiens
gtgagcagcggcggcagcggcaacccaaacagcaatagtaccagcaccagcacctctgccgccaccgcgggggcaggctcctgtgggaaaagcaaagaggagaagccaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaccaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaata

SEQ ID NO: 8735 - DNA, 2605 bp, Homo sapiens
cactccccctgtgtgtgtgttgtgtttcagtcctgatttagtgttgcagaacaagcttgttgtgtgtgtgcaccagggggatttttgttttgctttttttaaattttaatttttgcttttataaaaaatacacaggacggtctgtgacatttgatggtccatcttctttaataataaatttgttgaagagattataatttccaaaataaagcggctgcaaccaaacacattcaatgcagttagaaggaaaaggtcaactcgatccaatacagaccgaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaa

SEQ ID NO: 8736 - DNA, 2737 bp, Homo sapiens
cgcctgtaggtttgctacatgggatcattactgatcacggtgactctgaagtctggaactgaaggcggaatgagaagttgggaaaacttttttctctaaactctctgttttttaaaaaactattattctcgatgcttgttaagaggaaaaaaaaacctttggtgcttctgttgtgaatgtgaaacattattttccagctgtacagtgacacattttttttaaggagaaaaggactgattcgtttgccaaaaggggggtggggaggtggaataatgttatcgagtgattattctggctgagatgtgttatttggtttcttccttcttgatcatttggtgtttaagtaaaatgaggcacaggcttgtttgccgagtggagtgggaaaggcattttgatttgctggcctaattaaaaaatgataaaggattaaaaggaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgac

SEQ ID NO: 8737 - DNA, 1500 bp, Homo sapiens
ttatttttatttcttgcagttgtatgttcttattttgcccaagacttttggccaaagcagggcataaaaaattgtttccaaaaagtgatactgaaaagatataaaaaatgtggacatgaaaatttacagttaggaaaatactgtaaaagcatggatgagtgtaaggtgcacgaagaatgttacaatggacttaaccagtgtttgagaactacccagagcaaaatattacaatgtgataaatatgtgaaagtctttcataaattttcaaattcaaacagatataagataagacatactggaaagaaacctttcaaatgtaaagaatgtgaaaagtcattttgcatgctttcacacttagctcaacataaaagaattcatactagagagaaaccctacaaatgtaaagaatgtgggaaagcctataatgaggcctcaaacctttctacacataagagaattcatactggaaagaaaccctacaaatgcgaacagtgtggaaaagcctttaaccggctctcacaccttactacacataagataattcatactggaaagaaaccctacatatgtgaggactgtggcaaagcttttaaccaatctgcaaaccttactacacataagagaattcatactggagagaaaccctacaaatgtgaagaaagtggcaaagcttttagccagtcctcaacccttactacacataagataattcatgctggagagaaaccctacaaatatgaagaatgtggcaaatcttttaaccaatcctcaacccttactacacgtaagataattcatactggagagaaattctgcaaatgtgaagaatggggcaaggcctttagccggttatcccaccttactacacataagagaattcattctggagagaaaccctacaaatgtgaagaatgtggcaaagcttttaaacaatcctcaacccttactacacataagaggattcattctggagagaaattctacaaatgtgaagtatgtagcaaagcctttagccggttctcacaccttactacacataagagaattcattctggagagaagccctacaaatgtgaagaatgtggcaaagcttttaacctatcttcacaccttactacacataagataattcatactggagagaaaccctacaaatgtgaagaatgtggcaaagcttttaacctatcttcacaccttactacacataagataattcatactggagagaaaccctacaaatgtgaagaatgtggcaaagcttttaaccagtcctcaactctttctaaacataaggtaattcatactggagagaaaccctacaaatgtggagaatgtggcaaagcctttaaccagtcctcacaccttactacacataagataattcatactggagagaaaccctacaagtgtgaagaatgtggcaaagcctttaacaactcctctattcttaacagacataagatgattcatactggagagaaattctacaaacctgaaagt

SEQ ID NO: 8738 - DNA, 14386 bp, Homo sapiens
acacaagctcaggagtagctgccatgcacatcagtgtccattaaaatgacttgtagcaaatctctacgttcaaagtctaactttgacagacaaccttacttccagcgaagtctactcccctccctccggagggaagaatgggctgcggttaagcgtttgccctggtgtcagggccaactgcttcgaagcgccagactttcggagactgtgggtggggagcattaagcgggaaatgaccttcacatttcagtcagaggacttaaaacgtgactgtggtaaaaaaatgtctcatcaacacgtgttttccttggccatggaggaagatgtgaaaacagcagacaccaaaaaagccagccggatccttgaccatgaaaaagaaaacactcgctccatctgtctccttgagcaaaaaagaaaagttgtttcctccaacattgatgttcctccagcaaggaaatcttcagaggaactagacatggacaaggtgacagcagcaatggtactaaccagcttgtcgactagccctttggttcgaagtcctcccgtgcggccgaacgagagcctcagcggatcctggaaggagggcggctgcgtgccttccagcaccagcagcagcggctactggagctggagcgcccccagcgaccagtccaacccgtccacgccgtcgccgccgctctcggctgacagcttcaagcccttccgcagccccgcgcagccagacgacggcatcgacgaggcggaggccagcaacctgctcttcgacgagcccattcccaggaaaagaaagaattccatgaaggtgatgttcaaatgcctctggaaaaactgtgggaaggtgctgagcactgcagcaggtatccagaaacacatccgaaccatccatctggggcgcgttggagactctgactacagtgatggagaagaggacttttactacactgagatcaagctcaacacagactcagtggcagacgggctgagcagcctggccccggtctcaccttcccagtccctggcttcacctcctactttccccatcccagattcaagccgaacagaaactccttgtgccaaaacggagactaagttgatgacgccgttgagccgctcagctcccaccaccctctacctcgtgcacactgaccatgcttaccaggccacaccccctgtgaccattccaggatcggccaagttcacccccaatggcagcagcttcagcatttcctggcaatctcctccggtcactttcacaggcatcccagtgtcacccacacatcatccggtgggcacaggagagcagagacagcatgcgcacacggtcctgtcctccccacccagaggcacagtcagcttaaggaagcccaggggagagggcaaaaagtgtcggaaggtgtacgggatggagaaccgagacatgtggtgtaccgcctgccgctggaagaaggcctgccagaggttcctcgactgagagacccccaggcagaggggctcagggccctgagccgctcctgccctggcctgccactgcaggtgttggaaagagcttttcctactgaataaaacacagttgaagccaggaaaagccctttcaggaaccttggaggaataacagcaaaaacacagaaaaattgtttaagtcaccacctatgacaaaagaaagttgctcttactgagaacccagcttggagcagctataactagttttttttccttcaaaagaaaagtcaactttttttgctgtatgtctagacttaaaactgtggacttctgtagcaattgaaccaacaaagcccattttacctagaaaggaggcatattttgataagctttctgaattatgccattttcaagatttttttgacacttaaaaaacaagctacaggttattcagtagcatttgtacaaagatcaatacttacttttgttgtgaataatcttttccgtatcttccatttgacttcttggagcagtatatgtcaggatgtgttgcaagacagcgcagcactctgggcatcttttctatggctttttgtttgtttttcttttaagaatggccccacactgaaccatggtagagctattagtttgtagggccccagatggcataaactcgagaagggattgtccacggaaatcaccagcagacttcagcccgaagctgagttcaggaagtccagctgtcactgttgggaaacatctaggagtcttccttggatccataagaagctcttcccctaaaggcagcacagctaactctactctctacctgccacaactcagtcaagaattggcacctgtagccatctgggtaagcctcgatgcttctttcagggatgtgacacaaatggcaactcggagctatttgttactgcttgtctgtcaagattgtagccaggttaatgggtcattttccttctctccagactccaccactgactgatttcagaagaggtagagaactccaaactgtcccagcaggtttgctttagacaacagagcacagcccacatggccctacctgttcagaaagtcatgttagatcaacaaaccacttccattctgagtgcacttttataggttttatgctttagcatgtccgggagatgagttaattaacaatataaacattatgtgagtaaatggaaggtccaaactttaagtttttcttataaaaatattggagctattcatttaagaatttgctcaaaagggaacataacgccaaaaggaaaatgcatgtaggtataggaatttctcagtttagtagggccagggcttgcactatgttccatttattgggcttcgtaacttacttgcttgtttgtttgggggatagtggtgtggggagaggggagtcgtcaagccctataaataagctcattctctatctacccgactctcaattgccctgctaaagagttatttctcctatacctatgcaaagtaggaagagcaccttataggaggcactgtatagggacaggggacatgggatcagccataggaatgttaaatgaaattgcacagaggaaagtttaatatatgtctagagattatacatacacttttttaagcgtaaaaagaagacatctagtaatgacagatattctttttatatacaagcaaaagaaagtataaggaggttctacagtgcaacatccacaatctgtgcattcacatattatgggacttttattttttaaactctcatataaattttttaaaattactccttggaagagatcctggtttttttcttcatttatttttttctttaaaaacatttattttaagagaagagaaaaagagcttcatctaattttgcatcttgattaccaatcagtactagtcacagcaccagcaatactgtatgttttagactgacaaggtcagccaggaaatggcatttttttaaacgcagaaatgtgtttgtttcctctactctaacacgtcctttctcctcctggtgtcctgtcaccccccatgcagcaccactgatgcgagatgatgctctggcctggtccaggaagccctgagccatgggcagattgcccagtggccttgggcggccagagcttgtcacctgtttaaacaagttcaccatgtgtttaaatgacagggtacagtcctggaccagaggtttttctcttcagcaaagctccctggcccttgatcgttggactgttactaatagaaaaagattcaagtcatgaagtataaaatccatcccccatcccagaactttgaaacacaaggagggagagatctttgctatggagcagtcctggagcaaagccccgtggcttccacccccagatatataccccataagtagtgctgagctccagcttagctgagccaagctcagtccttatctggtgttcagccagtgcacaggtataagcagaactacagagctgaatgtagcttccctgggatctcttctcctttctaaagcatttttcacacagttctgtacctcctacccaagttggggctgctttctgcctgctagcccacggctctgtgtactttcttttctggcttcaggtgcagacagaccctcagtaccttcctggacacagacacatattccctggaccaaggcgtggaataactagtagaccaccaagccacaggtggctggtcttgaagaaaagggattatactccttacaggccacccagaaagctatgaattccaatatacaccactgatcgtgcaagttagggttttttttttttaaacgtagcattattttgttatattttggaactaaatgaagtgccaaattaaccagacattcgtttgatgccatctctgtggaaccaagttctctgtgtgtgttcgtttggctgggaggagggggaggactgggcagactgctcccacagcaggctggcagtggaactggagccctggccaccgcagggagctcagaggccaatctacgcaaaaggcatgcaaaacaatggattctggtcccaaaatatttctaagtaaggcatgatgtagccttttgattttttttttatcctttgacaccccagccttcagaaaaggtttttcatctctctccaaagaagtcatttcatagtgactgacaggacattctccagagagcgacaaagcagagtggccagcaggcagtggtgttaagccttgggccttcccagcagatgtgtgctgcattggtgggtgggaggcagtgtgacagcctggagaaaacacacaggtagcaagggagtcaggggggaggtacaagagggctgtggacacctggctcttgctcatcttcttggtgctgatcagctggtggtcaccatccctaagtacctcccagggagctgccattttctcctctgggagcagctgcctgaagcaaggagagaatgacctgaagggaagtacctccggccaagagtgcagggctgctgtgcctagcctgagcgggccatctctagcagatatggacttctctccaccacactagctgaaaagttttctcccttggttggcaaaagccagtgtcaggaaaaaagctgtgggtttctgaccaagaatgtgtgcgcttagctgcaaagtgcctgtcagcagctccaggcaccaacaaggtgcccttttattagacaattcctgcccgaacataaccatattgcagatgaaaattttcaatagagaatgacacaattcttgacctttctaaaaacttttcaaagagatagtcacatgtgtatatgttgcaaaagatttttgaaactgaaatgtcctccattaaatctcaagagcactcgagttttaagtctgctgtttctggtgtcacactaagacacacttttgaaagcagccctgggttctgaattagttggcactgctgaatccatgttcccccttcatcagactccaaagtgcagcattcacttgcaaaggttgagagaaaagtggccagaattgtacatataacagagaataccttgagaatagtagcaaaatactgtaaataatattcatttcctcagggaaaaataaagggcatgcaaaaataggtctggagactcctgaaactaggaagaattttgttatcactaaagtcttttatagtcagaacaatttttttttcaaatgaacatggtatcatttcaagacaaatttatgtgaactgggcagtactgacatttgtgaggcataggggagtgccctgggaaaacggtttggagctgacctgtagcctaaggctaacatttgaaccacaggtgcaatgcctgggggtgggggagggggacggggtgggggtggtattcctagactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagtgttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttcta

SEQ ID NO: 8739 - DNA, 712 bp, Homo sapiens
acgaggaggtggtcgtcgaggtggtggacggcgacgaagacgacgaggacggcgaggagcgtttcgtgcccctcggacccggccacgcagtccccaggggcccggcccggggcgcgttgaaggtggggagcattaagcgggaaatgaccttcacatttcagtcagaggacttaaaacgtgactgtggtaaaaaaatgtctcatcaacacgtgttttccttggccatggaggaagatgtgaaaacagcagacaccaaaaaagccagccggatccttgaccatgaaaaagaaaacactcgctccatctgtctccttgagcaaaaaagaaaagttgtttcctccaacattgatgttcctccagcaaggaaatcttcagaggaactagacatggacaaggtgacagcagcaatggtactaaccagcttgtcgactagccctttggttcgaagtcctcccgtgcggccgaacgagagcctcagcggatcctggaaggagggcggctgcgtgccttccagcaccagcagcagcggctactggagctggagcgcccccagcgaccagtccaacccgtccacgccgtcgccgccgctctcggctgacagcttcaagcccttccgcagccccgcgcagccagacgacggcatcgacgaggcggaggccagcaacctgctcttcgacgagcccattcccaggaaaagaaagaattccatgaa

SEQ ID NO: 8740 - DNA, 1207 bp, Homo sapiens
gtccttgtcccaagggacatacagcacacagcctgtggagggtggaggaaccaactgcaagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactagagaaagtgacttttgaagatgtagctattgacttcacccaggaagagtgggacatgatggacacatccaaaagaaagctgtacagagatgtgatgctggaaaatatcagtcacctggtgtccctcgggtaccagataagcaaatcctatataattttgcagctggagcaaggaaaagagctgtggtgggaaggaagagtatttcttcaagaccagaatccagacagggaaagtgcccttaagaaaaaacacatgatatccatgcatcctatcatcagaaaagacacatccaccagtatgacaatggagaactctctcattctggaggatccttttgaatataatgattcgggagaagattgcactcacagttccacaataactcagtgtttgttaactcacagtggaaagaaaccctgtgtcagcaaacagtgtggaaaatcccttcgtaatcttttgtcccctaaaccacgtaaacaaattcatactaaaggtaaatcatatcaatgtaatctatgtgaaaaggcctatactaattgcttttaccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggacaaaagtgttatgaatgtgataaaagtgggaaagcctttagtcaaagctctggctttagaggaaacaaaataattcacattggagagaaaccacctgcttgtcttctatgtgggaaggccttcagtctgtcctccgaccttagatgacatgagagaacacgcactggag

SEQ ID NO: 8741 - DNA, 3377 bp, Homo sapiens
attttctcaagcaatttttaaatttcattcttttaccttattgagcttttcttagtgcctaaagtgtctgcaagtggaaatccagaggaagacagagagaaactgagttcctgacaatgcattcactagagaaagtgacttttgaagatgtagctattgacttcacccaggaagagtgggacatgatggacacatccaaaagaaagctgtacagagatgtgatgctggaaaatatcagtcacctggtgtccctcgggtaccagataagcaaatcctatataattttgcagctggagcaaggaaaagagctgtggtgggaaggaagagtatttcttcaagaccagaatccagacagggaaagtgcccttaagaaaaaacacatgatatccatgcatcctatcatcagaaaagacacatccaccagtatgacaatggagaactctctcattctggaggatccttttgaatataatgattcgggagaagattgcactcacagttccacaataactcagtgtttgttaactcacagtggaaagaaaccctgtgtcagcaaacagtgtggaaaatcccttcgtaatcttttgtcccctaaaccacgtaaacaaattcatactaaaggtaaatcatatcaatgtaatctatgtgaaaaggcctatactaattgcttttaccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggacaaaagtgttatgaatgtgataaaagtgggaaagcctttagtcaaagctctggctttagaggaaacaaaataattcacattggagagaaaccacctgcttgtcttctatgtgggaaggccttcagtctgtcctccgaccttagatgacatgagagaacacgcactggagaaaagccatatgaatgccatttatgtgggaaagccttcagtcaatgtactaatcttaaaaagcatcagaaaattcaccctggagagaaaattataaacttcttcagaacatattctgactttagatgacacagtgttaggaatgacgaaggtaaggaatgtggaagagacttcagctgtagttgtagcatctaaacatgccaaaggactcacattttgaagaattactgtaatcaacatggaagatacttcagttgcctttattcttcagcccacatcaataaattcatatggaagagaaattgtatgacatgtatgtaccaaagacttgttagtgatctgagcataaatgacatgagagagctgaaactgtcagcataatcaactaaaagtcttcagcaacagctttaacttaaaacatgtgggactttcaggtagagaatctctaactctgcattcagtgtgaaaatgtttttatttgcaatttattgtcaaataacatgagaaaactttacttggatgaaccctttatttgtatttttctgtgaatgaacattcagccaagcaccaggcttgatgttcacaagagaagagtgacaaaatgctgctaaaatggaaaataagagaggaaagccttcataagctaaataacaagggaaagtctttccaagggcaatgaattctcttggaataccaaatacttcttactggagaagttatgcaatgaaaaatcatgagaaatcctttcttcatagagcaacacatgtggcacatgtgagatttcacactggacaaaacagggttagcatcttgaaagaagaaaattctttagtggtaattcatttcttagttgacattcagtttctcacattgaggagctatcaaacttgaaaatcactgtggagaaacctgatagatttctcatcagaaaagtgagtcaagaaggtggacctctagaaaaaactcttaacacatactttagcaaaataattcagaaatttgagaaaatatctattcataaaaatgtggcatgtaaatgcataatagcaaagtgaccaaggaataaattgaatgcagaattatataagaaatctcattaaacttttccaaaagagcaatacttacaaatattgaaagaatacaatctgttgttgaaaaaacttagtatgttggtgaagcccttgtttcatttatgcagccctaacaaactgattcgcatctgaactccttgggtgagattcttggtggagattctaccccaacttctgagtctccccagtcttcaacagctctttcctcacagctcacctccctttacttcaacgtccaccaaaaccacttgtttccatccaaccctcgagttgacacaccagggatcttcagccccacttgctagatttctcagtttgtcattgcatagatttagcagggaaatggaggctgtatcaaagacccctagtatatgcatttgggtgtccccagctcttgcctctgtctctgagcagttacctgggatcagagaataaggcagctcttctcttctatccctcagaaggctcttgaaattttgtccctggagcctctctaactggaagtagcagttcatctcatgacaccccacattttattcaggtgagtcctgagttattacacagagacagacacagctgtgctccttttactgcagtccagaagataaaacaccagcatgataaaacagccgaacctgtcagccaccttgcaagccttttctatatttgattcaatgtacttttcccgaagcaaaatgaaagttctcacagaggggccctcctctgccttgtcctcagaattggaaaatgtattgtccgtgaaggagcctcaccactgaacctaaaactcaagagaaaatgtttcctaaatatcaagtgggatgacttgaaattttgtcaaacaggcagaatcttaatacgatcggccttactaaggctaaatggccttatccatggttgaaattgacacatcatcatattaaaaaatctccacgagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtggctgacattatatgtactcctgagccacattaagatgtactatttgtgctgtgaaattctatgggatttgacaaatgcatggtggcagatctccagccattattaaagcgtaacacagaatgcttctcttattcaa

SEQ ID NO: 8742 - DNA, 925 bp, Homo sapiens
gagagaaactgagttcctgacaatgcattcactaaagaaactgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggtaaatcatatcagtgtaatctatgtgaaaaggcctatactaattgctttcaccttagacggcacaagatgactcacactggagagaggccatatgcatgtcatctatgtagaaaagccttcactcagtgttctcaccttagaagacacgagaaaactcacacgggacagagaccatataagtgtcatcaatatgggaaagtctttattcaatcctttaaccttcaaagacatgagagaactcaccttggaaaaaagtgttatgaatgtgataaaagtgggaaagcctttagtcaaagctctggctttagaggaaacaaaataattcacactggagagaaaccacatgcttgtcttctatgtgggaaggccttcagtctgtcttccaaccttagatga

SEQ ID NO: 8743 - DNA, 3644 bp, Homo sapiens
gtccttgtcccaagggacatacagcacacagcctgtggagggtggaggaaccaactgcaagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaaagaaactgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggtaaatcatatcagtgtaatctatgtgaaaaggcctatactaattgctttcaccttagacggcacaagatgactcacactggagagaggccatatgcatgtcatctatgtagaaaagccttcactcagtgttctcaccttagaagacacgagaaaactcacacgggacagagaccatataagtgtcatcaatatgggaaagtctttattcaatcctttaaccttcaaagacatgagagaactcaccttggaaaaaagtgttatgaatgtgataaaagtgggaaagcctttagtcaaagctctggctttagaggaaacaaaataattcacactggagagaaaccacatgcttgtcttctatgtgggaaggccttcagtctgtcttccaaccttagatgacatgagagaacacgcactggagaaaagccatatgaatgccatttatgtgggaaagccttcagacaatgtactaatcttaaagagcatcagaaaattcaccctggagagaaaattataaacttcttcagaacatattctgactttagatgacacggtgttaggaatgacaaaggtaaggaatgtggaagagacttcagctgtagttgtagcatctaaacatgccaaaggactcacattttgaagaaatactgtaatcaacatggaagatacttcagttacctttattcttcagtccacatcaataaattcatatggaagagaaattgtatgacatgtatgtaccaaagacttgttagtgatctgagcataagtgacatgagagagctgaaactgtcaatataatcaactaaaagtcttcagcaacagctataacttaaaacatgtgggactttcaggtagagaatctctaactctgcattcagtgtgaaaatgtttttatttgcaatttattgtcaaataacatgagaaaactttacttggatgaaccctttatttgtattttctgtgaatgaacattcagccaagcaccaggcttgatgttcacaagagaagagtgacaaaatgctgctaaaatggaaaataagagaggaaagccttcatgagctaaataagaagggaaaatctttccaagggcaatgaattctcttggaataccaaatacttcttactggagaagttatgcaatgaaaaatcatgagaaatcctttcttcatagagcaacacatgtggcacatgtgagatttctcactggacaaaacatggttagcatcttgaaaggagaaaattctttagtggtaattcatttcttagttgacattgagtttctcacattgaggagctatcaaacttgaaaatcactgtggagaaacctgatagatttctcatcagaaaagtgagtcaagaagttggacccctagaaaaaactcttaacacatactttagcaaaataattcagaaatttgagaaaatatctattcataaaaatgtggcatgtaaatgcataatagcaaagtgaccagggaataaattgcgtgcagaattatataagaaatctcattaaacttttccaaaagatcaatacttacaaatattgaaagaatacaatctgttgttgaaaaaacttagtatgttggcaaagcccttgtttcatttatgcggccctaacaaatggatttgcacctgcactccttgggtgagattcttggtcgagattctaccccaacttctgagtctccccagtcttcaacagctctttcctcacagctcacctccctttacttcaacgtccactaaaaccacttgtttccatccaaccctcgagttgacacaccagggatcttcagccccacttgctagatttctcagtgtgtcattgcatagatttagcagggaaatggaggctgtatcaaagacaccttgtatatgcatttgggtgtccgcagccctttcctctgtctctaggcagttaactgggatcagagaataaggcagctcttctcttctatccctcagaagactcttgaaattttgtccctggagcctctctaactggaagtagcagttcatctcataacaccccacattttattctggtaagtcctgagttattacacagagacagacacagctgtgctccttttactgcagtccagaagataaaacaccagcatgataaaacagccgaacctgtcagccaccttgcaagcctttcctatatttgattcaatgtacttttcctgaagcaaaatgaaagttctcacagaggggccctcctctgccttgtcctcagaattgaaaaatgtattgtccgtgaaggagcctcaccactgaacctaaaactgaagagaaaatgtttcctgaatattaagtgggatgacttgaaattttgccaaacaggcacaatcttaatacgatcggccttactaaggctaaatggccttatccatggttgaagttgacacatcattatattttaaaatctctacaagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtgactgacattatatgtactcctgaaccacattaagatgtactatttgtgctgtgaaattctatgggatttgacaaatgcatggtggcagatctccagccattattaaagcgtaacacagaatgcttctcttattcaagctcgtcttccctccacatagagggaatcaatcggcttttgtatactgatttttgaatttgcttctttatttccatcttctttaattaaagcacaaggtatc

SEQ ID NO: 8744 - DNA, 2615 bp, Homo sapiens
gggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatattcatccccatgtttaactgacacactgggggctcagttgtgtgctgtaatgtcttattaaagaagatattaaagaaaa

SEQ ID NO: 8745 - DNA, 604 bp, Homo sapiens
ctttgcagccccctcggaaaaccacactgagagttgcattaaaaaccagcatatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatca

SEQ ID NO: 8746 - DNA, 501 bp, Homo sapiens
agcctgggaggagcgggaaaagggtcgcagcgcctgaggcccggccgccgcccgagtggatgagcgagcgagcgacttgtgaaacacgccgcggcccggtcaccaaccaggaccgggatcacgtggctcccagggctgggtgaagaagccgcccggaccgagcgcgccggagaggaggggcgcctggggacagaaggcgacgtcccctgaaatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttag

SEQ ID NO: 8747 - DNA, 959 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacg

SEQ ID NO: 8748 - DNA, 3502 bp, Homo sapiens
gcgggaaggggatgagttcgggcgcctgccaggccctgcaggtggccgggtcgcaggccagccgcggaagcggagcggtaaccttacccccggcgacagccgccggtcagctgccagagtgtggcgctcccggtggacgcaggggccgggtttcgggcagtctcggcctccaggaggcgcgtcttggtccagggtccgtgaggactggctagatgggggctgcgtggcctttggtggcagggaggaggagggggtctccgaggcgggagaggcgggtttgggaaggaaggtgcgccaggctgaagctggggtcggagaagtgttgggtggagacctcactgtgggtgcgttcctcctctcctctccccaaaacgatggtgttaaaagctagggtcaggatgtggagcgctgcctgggcctcttcctttccgatggttatggagaatgagcctacttcctggacccaaaatccttttcttctgttactcatttatgttggttttaaaaggagctttggggcagagcttacttgttgcctcctacgagagcgcctcattttagaactcgtttcttccactacttccctctttgcagccccctcggaaaaccacactgagagttgcattaaaaaccagcatgtaggtatttgtaagtgactttttccctccagtttgtcgcatttaatcaaggagcggttgtagctgcctacgattttgtagaaaattgtgttggcttgagagcaagtcctaagttgagctgtccaaaagcaggtggttggttcgtttgaatttctgctttcagaaaggaaatcgatggggcgtgttgtcagaagttaggggcctacctcatgcatttagcttattttattccatttcctttacctggtgttaagttttctgtcttcagaataagaacaagtgactactgtctttattaagtctcttcggtctttttggttgctgtttggtgacaatggaaaatgggttgaatctattgtgtaatgttatattttagggaaagtcctaagtgcaaaagttaaaaataattttgtgtgtctaatgacattgctttgtacgagtcacaacatggaaatatcaaaatagctagtaacttctagaaagcaaaggaacttctgaaattagtggcttaccatttttgaagattttttttaacataaaacaagatttcccacaaaatcagtgtattaagatacataaaatacattgtgtcgaagagttaagatgtgtgagaagactggctattttgttacaaggtcctgatagtaagacattgagacaaaaaaccttgcaaaacattggtatacataaaggctgatcacgtgactactgtcgtccaaataatacataagtatccaaacctgtttccatgggaataggtttgtaagcttgcggtaacatcggacttaaatacacttttaaaaaaaatgtgccatttggcttagaattaataattttttttaaagcaaaaatggaagcttagtcttcaaggactgataacagctggtaatatttaccattgtttggtgggaatggggttctcatattaggctagcacgctaaacattttcaattacgaaaatgtattaggctcgtgtgctaccctaatataaaaaccccatatttcctcagttgaaatagtcagctgactatcctgaaaagcattgaccctcttttatattttatctgactttcagttcatttttttaatgctagtgggaacttctccaatcagtgtatttttttagtttccttttttggggaacaggaggagctcagtaatttttatgaaatgctttgacctcatatccattaactaattatggtcctagtcagaagaagctagcacccttccctggtgaagttgatacaaatccattgtatgttcctgtcctgcaatgatttacattcagttacagtactagtcaaaactatatatatatgaattctacttaggatccaattttgatatatttaaaaagcaattgagactcatgatagactttatgagcaggtttaacttgtgtggtcgaataaaagcctttaatttaaatggaaaagtaaaagtaacttttttcagtgacttgatttttttttttgttttaatccatttgggttcacgtcagatcatcggtaacaaaaagtggtatctttcagctttgtaaaagaaccctcttaaccaagttcattccctcaaatgggaactaacgtctagagagcaaagaaacttctggaattagtggcttgctgataatctcattttataatttgttcagcaatccagcaagaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatacagtaaagtgcataaatcttgagtgtacaattcaatgaatttttataagtaaacacacttgattcaagaacattttcaggaccccataagtccccttcatgtcctgtcttcccagtcattacccataacccccaaggtgacccctttcactatagattagctttgcctgttttgaactttaaataatgtatattccccacaactggcttctttcctttaacattgagatacaaccaagttgttacttgtaacaattttttgtttgtgtgtttgtttatttatttttgagaccagagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacga

SEQ ID NO: 8749 - DNA, 488 bp, Homo sapiens
gggccggggccgcggtgtcctgggtggcggggctccgggaatgtgactcagccaccgcggccccgcgatccgctcccgggccagcgcctcagtcggtgccgaggagggcggcgccgagacgggcgcgtcagcctgggaggagcgggaaaagggtcgcagcgcctgaggcccggccgccgcccgagtggatgagcgagcgagcgacttgtgaaacacgccgcggcccggtcaccaaccaggaccgggatcacgtggctcccagggctgggtgaagaagccgcccggaccgagcgcgccggagaggaggggcgcctggggacagaaggcgacgtcccctgaaaccagagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattca

SEQ ID NO: 8750 - DNA, 782 bp, Homo sapiens
ctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacagggtttcccaaactctcgattgcctcttgcaagcagatgacctgggagcaaatgttatggcagaacgatggactcctagcaagggccgaagcgtgccctgtgaagactggaaagaatatatgcttgtcagagatttggtaacctcatcaagaccttaaactgcagtttaagagggtggaaaaattactcaagtgaaactataagccctgttattcgtaagaaaacgtatgacacagagcaattggagaatctcttaatttgcatgcaaaaataacaggaggaaaaagtaaggaatgttatatctgatttcaagtgtgaatatgaagcaaaggaacttgagatgttaacacctgaaagaaatcaagatttcctagatacccctgaaacacagggctcaggactagaatatggaagccctgagagaacagatagcagaggagcattatatgtccaaaatgtctgaaagtgcacagaaagccagaagcctgcacgaagaggtgggatggagaat

SEQ ID NO: 8751 - DNA, 732 bp, Homo sapiens
gaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggccccctcggaaaaccacactgagagttgcattaaaaaccagcatagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgt

SEQ ID NO: 8752 - DNA, 493 bp, Homo sapiens
gaggggtcgcggggggcggcagggcccggcccggggcgggccgcgggaaggggatgagttcgggcgcctgccaggccctgcaggtggccgggtcgcaggccagccgcggaagcggagcggagctttggggcagagcttacttgttgcctcctacgagagcgcctcattttagaactcgtttcttccactacttccctctttgcagccccctcggaaaaccacactgagagttgcattaaaaaccagcatagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactg

SEQ ID NO: 8753 - DNA, 2218 bp, Homo sapiens
ctaccggcgcggcgtagtggatgcagcatcctagtggaggacgcccctgtgatggagtctcactctgttgcccaggctggagtacagtggcgtgatctcggctcactgcaagctctgcctcccggttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcggga

SEQ ID NO: 8754 - DNA, 2183 bp, Homo sapiens
aaaagtctgggctaccggcgcggcgtagtggatgcagcatcctagtggaggacgcccctgtgttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagccaatta

SEQ ID NO: 8755 - DNA, 2104 bp, Homo sapiens
ctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctc

SEQ ID NO: 8756 - DNA, 1929 bp, Homo sapiens
agcggacaggacggcttcggggatgtggcggggcctttgtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggccaaggcaggtggatcatg

SEQ ID NO: 8757 - DNA, 6809 bp, Homo sapiens
tttgtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggtaagataattcatactggagaaaacacctacatgtgtgaacaatgtggcaaaacttaaccagtgctcacaccttattgcacaggaaagcatttgtacttgagataaattatacaaatataaagactgaaaaagccattaatatatgttcatatctcaacaccagatagttcatacttaataaaagcattataagtacaattactgtcaaaagacctttcagaaaatacaagcttttgaccaggcgtggtggctcaggcctataatcccagcactttggtaggccaaggcaggtggatcatgaggtcaggagtttgagaccagcctatccaagatggtgaaaccccatctctactaaaaatacaacaattagccggttgcggtggtggtgcctgtaatcccagctactcaagaggctgaggcaggagaatcacttgaacttggggagggagaggttgcagtgagctgagattgcactctagcctgggccacagagcaagactccatctaaaaagtaaaaaaaaaagaaaatatgaactttacagtgaagaatatttattttgaagatgaatgttacaaatataaagtgggtagtagtgcctttacttgtatcacagatcttattgtagacattttttgtagaggaaaaactctgaagcactttcacactttgttcaatatcagggaatttatattgaagaaaaatcatgcaaatgtagtaaatttggaaaaacactttttcaaaaactacagcttagaaaacagagttcatactagaatatatttttgcagatgcagtaaaagttaaaaaaaatttaatccataagtaagtctgtgtaaatatcagaatttatggtagaaatacataaggcactgacaacatcagatatactaaatcagagggctgagtatagaaaattaaagttggtagaaaaattatttgtatataactttaagaggatcagaaggttttttgcagttataattacattcaaagtatactttatttcttgaaaaatattacagattttttgaaaagtgaataatgatgtcattcaactctgaaattcctgccgtttcttcattcctattggattcacatgtgaaagcatgggatcaattattgctgtatcaaagatatgaaagattctttctttgttttgttctgtttttttgagatggagttttgctctttcgtccaggctggagcacagtggcatgatctcggctcactgcaaccttcaatttccagtttcaagcgattctcctccctcagcctcctgagtagctgggattacaggcgcatatcaccacgcccagctaatttttatgtttctagtacagacaggatttcatcatgttggccaggctggtctcaaactcctcaccttgtgatccacccaccttggcctccaaaggtgctgggattacacaggcatgagccactgctcctggcaagagattcttttttattaggtgggcattatttgtgatcttttctattgaaaagtaaaaacattagaatgtaagatgcataatgaaaatgtaagtggagaggttctttggggttaacttataatattgagtggtgcatgaggttggtgttcagagtaatattctgcattatgaaaaaacatttaattttatttaaaatttagtttatcatactaattgtacttttatataagatgcagtacatttttaaaattttagattgtgtgaagttaatagtttaacatttttaacatgttaaatactattgtgcattcaatgaagcattattataccacaaactttaccctgttccaccttactgaagggtataggtaaaagatggtaacgatatactatttagtaacataatggattaacatctctagtaattttttttgccagtggctttaaaccgcaaataagttaaagaatattgtttctgtaggttaaatttttattttgtttttaatcatttaaatttaattttggtgggtacataatatgagtatatatttatgcacttatatggcatattttagtacaggaatacaatatataatagtagcatcagggttaagtgaggcatccttcacccatagcatttctcctttgttttacaaacaatccaaacctacactttttaaaaattttttgttgttgttgttcttgttgttgttgagacggagtctcgctctgtcgcccaggctggagtgtgcaatctcggctcactgcaagctccacttcccgggttcacgccattttcctgcctcagcctcccaagcagctaggactacaggcgcccaccaccatgcccggctaattttttgtatttttagtagagatggggtttcaccatgttagccaggatggtctcaatctcctgacctcgtgatctggtctcgatctcctgacctcatgatctgcctgccttgacctcccaaagtgctgggattacaggcatgagccaccgtgcccggccactttttataaattttaaaatgtacaattgttatttactatagagttatttttatggtcataatacaaattatatatgagtataaataaaattcatttctaaactattaatattttttccaaattgttatatatttttctttgaacatgtggcctgtctgcctgcaaacatgcagactttttgattcacatagagttaaatatgtattagtctaaagacaaactttaggtgtaagaaaattatggaataagtgtgtgtgtgtgagtatgagtttgtacctattttcagaaaagaacaatatgggaataaaaatcattttaataaggtggctactataaaactaaaaaccttaaaaaatgctgaaagcaaatgtatactttgtgctttgtattgaatttattactgtacaatccatgacttacagttctgaaccttttcatgcaaattctctgtatatacttgcctggtactcatgctagacccatactttttttgtttcttacattttttttgttttatggtttaggaagtattcattatatgagctggtctgtgattataagaatttttatgaaatttagtgcacacaaaataatttttagatgtaattccaaaagtagtgtattaagttacattttatttagtgagagcactccattttgttcttttaaggggagaacaatatataagttttcttttctttagtgattgttcctttcactttttataattgacataagtatatttatttattgagtcaatttgttcaggtaagtactggggggcttcataagtcatgaggatgtttttatatataaatgtagcaaacatacattacagttcttactgtgtaatcgatgctccataataattcacaaatattcctgctggagttagtttgtaatttcaagtcagaaatgaaagatatcagtggtgaagaaataagattgattcttcatatggagtggacattttttccagactataaaactgaatcttgctgaatttaaagagaaattctggccgaggcagatggatcacctgaggttaggagtttcagaccagcctggtgaaacccggtctctactaataaactacaaaaattagctgattgtggtggcatccacctgtagcccagctactcaggaggctgaggcagaagaattgcttgaacccaggaggcgaagattgtggtgagccgagattgtgccattgcactacagcctgggtgacagaatgagactcataaaaaaaaaaataaattctgcttcttttattttctacttctcttcagatttgtttctcgtatgtattttccaactatgtatgcatcacagcccttctttttctgagttatagctacagttttctgactgttctcttcacgccatttcatttcgcctggtattttgtagattttgatgacaaaattctatttttagtgcacttaaaaatggattttaactggtgagttcgcttatcaatataacattcagattagttaattaagataaaagccaggtgtggtggctcacgcctctaatcccagcactttgagaggccgaggcaagtggatcacttgagctcaggagttcgagaccagcctgaccaacatggtgaaaccccgtgtctactacaaatacaaaattagccacatgttgtggcgcatgcctgtaatcccagctactcgggaggctgatgcaggagaatcgcttgaacccaggaggcagaggttgcagtgagccgaaattgcgccattgcactccagcctggacaagagcaaaactctgtctc

SEQ ID NO: 8758 - DNA, 3798 bp, Homo sapiens
atgggactgttgacattcagagacatagctatagaattttctctggcggaatggcaatgcctggatcatgctcagcagaatttatatagagatgtgatgttagagaactacagaaacctggtctccctgggtattgctgtctctaagccagacttgatcacctgtctggagcaaaataaagagccccagaatataaagagaaatgagatggtagccaaacacccagttacatgttctcatttcacccaagaccttcagtcagagcagggcataaaagattcactccaaaaagtgatactgagaagatatggaaaatgtggacaggaggatttacaagtaaaaaaatgctgtaaaagtgtaggtgagtgtgaggtgcacaaaggaggttataattatgttaaccaatgtttgtcagctacccaaaacaaaacatttcagactcataaatgcgtcaaagtctttggtaaattttcaaattccaatagacacaagacaagacatactggaaagaaacatttcaaatgtaaaaacgatggcaaatcattttgcatgctttcacgcctaaatcaacatcagataattcatactagggagaagtcttacaaatgtgaagaatgtggcaaatcctttaactgctcttcaacccttactagacataaaagaattcatactggagagaaaccctacagatgtgaggaatgtggcaaagcttttagctggtctgcatcccttactaaacataagagaattcatactggagagaaaccttacacatgtgaagaacgtggcaaagtctttagccgctcaacacttactaactacaagagaattcatactggagagaaaccctacacatgtgaagaatgtggcaaagcctttagccgctcttcaacacttactaaccacaagagaattcatactggagagagaccctacaaatgtgaagaatgtggcaaagcctttagcttatcctcaacccttaagaaacataagatagttcatactggggagaaactctacacatgtgaagaatgtgggaaagcctttaccttctcctcaactctaaatactcataagaggattcatactggagagaaaccctacacttgtgaagaatgtggcaaagcctttagcttaccctcaaccttcacttaccacaagagaactcatactggagagaaaccctacaaatgtgaagaatgtggcaaagcctttaactgctcctcaacccttaagaaacataagataattcatactggagagaaactctacaaatgtaaagaatgtgggaaagcctttaccttctcctcaactctaaatactcataagaggattcatactggagagaaaccctacaaatgtgaagaatgtgaccaaacttttaagtggcattcaagtcttgctaatcataagaatatgcatactggagagaaaccctacaaatatgaataatgtggtaaagtccagccctcaggccttataatacataaaataatttatactggaaaaaatcactacaagtgtggagaatgtggccaattctttaaccagttccaaaccactgctgtccataagataattcatattggacaaaagtcttataaatgtaaaaaaaaaagtaacagcctgggtgacagagcaagaatccatcttaaaaaaaaaaaaaaagcgtaaatgtgattactgtaaaaagacctttcagaaaacataggcctttaaagcaaagactatttattctaaagacaaacattaaaacataaagaggattgtgtagtacctttatttgtattacggattttattgtacacattttatatcaaaggaaaaccctgaaacagatgctcaaactttgttgaacatcggagaatttatattggagagaaagtgtaaatgaatgtcaaaaaatatttgttcaaaaactacagtttagaaaacactagtttatactaaaaaaatatttttgcagatgcagtaaatggggaaaatatgtttaatcaaaaattaagtctacataaacatttgaggattcacagtagaaagaatgaaggtgctgaaacttcagacattacactaaatcagagtgttgagtgtaaaaaagatataaatctaacaatataaatttaaagaagtagatttatttggagatttataattacattcgaggtatgcttctttctttgtaaaaaaaaatatagattttctgaaaagcaaatagtaatgtaactcacatttcaaattacttcatgttgatcctttcttcccattgtttctgtgaaagtattggaccaattgttgaatcagagatatgagattgttttttataggtgtccattattcatgaactttcctatggatgagtaaggacattaagttgtaagatgcataatgaaaatctaaatggagaggttctttgtggttgacttataacattgttttagtgatgtataaggcgagcgttcagagtaatattctaaattctagtgaggaaaacctttgaacgtcagtagtaaattattttatcaattgtacctttatgtaaacaaagttgtttttaatgagctaaaactattgtgctttgaaagaagtattaagctgccattgactctatcgtgtctcatcttaaggttctgcgtaaaagatggtgacaatatactatttgttaatgtaggggaatgacatcactagtagtctcttttttgccagtgtttttgtttgtttgttttgagactaagtcttactctgtcacccagactggggtgcagtggtgcgatctcagctcactgcaacctccacctcctgggtccaagtgattctcctgcttcagcctcacaagtagctggaactagaggcaggcaccaccactcctggctaatttttgtatttttagtagagatgaggtttccccatgttggccaggctggtctcaaactcctgacctcaggtgatacacccacctcggtgtaccgaagtgctgggattacaggcatgagccaccatgcctggcctactagaggttttacacagcaaacaagttgaagaattttgttcccataggacaaatttgtacttttttaccttatttaatttttttttaatttttgtgggtagtgtgcatacacacttatggcatatatgagatatgttaacacatgcacataatatttaatgatcacaacagagtaaatgaggcattcatcaccttgagcatgtatttatcctttgtattacaaacaatcccattatacagttttagttatttcaatatgtgcaattgaattactattaaccacagggtcattttatgatcataaaaattacatgagtataattaatacccatacatttctgagtcttgattaaatatttttaaaattttgttttataaattttttgcacatgtggcatctctgctgacaaacaaaaacagacttttagtttcaatttacatagagttacatatacaaatatattactctaaagatataccagccgagcacagtggctcccagcattttgggagcctgaggtgggaggatcatttgaggttaggagttcaagaccagcctggccaacatggtgaaaccccatctctactaaaaatacaaaaaattagctgggcatggtggtgcatgcccatggtcccagttactcaggaggctgaggcaggagaattgcttgaacctcggaggtggaggtagcagtgagctgagatggtgctactgcactccagcctgggtgaaagagcgagaaaccatctcaaaaaaaaaaataaataaataaaagatataccttaagcat

SEQ ID NO: 8759 - DNA, 5197 bp, Homo sapiens
ctttttgcttctctgcgcccagagctccagtccttctcttcactgctctgcgtcctctgctcctggaggccaagcctctgtggccttgtgtcctgcaagtattcgcagatttatggctaaaagaccgggaccccctggaagccgagaaatgggactgttgacattcagagacatagctatagaattttctctggcggaatggcaatgcctggatcatgctcagcagaatttatatagagatgtgatgttagagaactacagaaacctggtctccctgggtattgctgtctctaagccagacttgatcacctgtctggagcaaaataaagagccccagaatataaagagaaatgagatggtagccaaacacccagttacatgttctcatttcacccaagaccttcagtcagagcagggcataaaagattcactccaaaaagtgatactgagaagatatggaaaatgtggacaggaggatttacaagtaaaaaaatgctgtaaaagtgtaggtgagtgtgaggtgcacaaaggaggttataattatgttaaccaatgtttgtcagctacccaaaacaaaacatttcagactcataaatgcgtcaaagtctttggtaaattttcaaattccaatagacacaagacaagacatactggaaagaaacatttcaaatgtaaaaacgatggcaaatcattttgcatgctttcacgcctaaatcaacatcagataattcatactagggagaagtcttacaaatgtgaagaatgtggcaaatcctttaactgctcttcaacccttactagacataaaagaattcatactggagagaaaccctacagatgtgaggaatgtggcaaagcttttagctggtctgcatcccttactaaacataagagaattcatactggagagaaaccttacacatgtgaagaacgtggcaaagtctttagccgctcaacacttactaactacaagagaattcatactggagagaaaccctacacatgtgaagaatgtggcaaagcctttagccgctcttcaacacttactaaccacaagagaattcatactggagagagaccctacaaatgtgaagaatgtggcaaagcctttagcttatcctcaacccttaagaaacataagatagttcatactggggagaaactctacacatgtgaagaatgtgggaaagcctttaccttctcctcaactctaaatactcataagaggattcatactggagagaaaccctacacttgtgaagaatgtggcaaagcctttagcttaccctcaaccttcacttaccacaagagaactcatactggagagaaaccctacaaatgtgaagaatgtggcaaagcctttaactgctcctcaacccttaagaaacataagataattcatactggagagaaactctacaaatgtaaagaatgtgggaaagcctttaccttctcctcaactctaaatactcataagaggattcatactggagagaaaccctacaaatgtgaagaatgtgaccaaacttttaagtggcattcaagtcttgctaatcataagaatatgcatactggagagaaaccctacaaatatgaataatgtggtaaagtccagccctcaggccttataatacataaaataatttatactggaaaaaatcactacaagtgtggagaatgtggccaattctttaaccagttccaaaccactgctgtccataagataattcatattggacaaaagtcttataaatgtaaaaaaaaaagtaacagcctttaaccacccctcaaaccttaatgaacccaagagaatttatttaaaaaaatttttttgagacagagtctcactttgtcacccaggctggagtgcagtggcacgatgtcagctcactgcaacctctgcctcctgggttcaagcgattctcctgcctcagcctcctgagtagctggaattacaggcacgtgcaaccacactggctgagttttgtatttttagtagagatggggtttcaccattttgaccaggctggtctcaaactcctgacttcaggtgaaccacctgcctcagcctcccaaagcctaagagaatttatattagagagactctacaaaggtcaaaaatgtgacaaaacatttaagcacatctcaggccttacacaatatcagataattcattctagagacaaaccctacaaaaacaatgtggtaaagcttttacctagtcttgaacccttattatacactaaaagaattgatactgaagaaaaaccctacaataaggaatatggaaatgtcttttaaaagtcctcaaactttttgtttgaataaatgtaaaataattgatactggagagaacccctgcaattgtaaaaaaaaaaaaaaatgtggcaaagcttttaactggttctccatctttattaattaaaatattttatactggagagaaactctacatacataaaaaatgtgacagcatttaaccacacctgacatttttctaaaatagagaaatcatactggtgaaaaactctagaaatgtgttaaatgaggtaagtcctttaaatggtagttgcatgttatggtaggtaagataatttatactgaagaaaactcaggcaaatatgaaaaatgtggcaaaacttttaacaaattttcccatcttattgcacaggaagccttttatactagagaaaaattgtaaaaatataaagaatgtgaaaagccattaatgtctgttcacatcttactcaatatcagaaagtttatacttaacaaaagcattataggctagatgtggtggctcatgcctgtaatcccagcactttgggagctcatggcaggtggatcatgaggtcaggagttcaagaccagcctggctaacatggtgaatccccatctctactaaaaacacaaaaattagacaggcatggtggtgtgcacctgtaatcccagctactcaggaggctgaagcaggagaattgcttgaacccaggtggtggaggttgcagtgagtcaagatcaccccaccatactccagcctgggtgacagagcaagaatccatcttaaaaaaaaaaaaaaagcgtaaatgtgattactgtaaaaagacctttcagaaaacataggcctttaaagcaaagactatttattctaaagacaaacattaaaacataaagaggattgtgtagtacctttatttgtattacggattttattgtacacattttatatcaaaggaaaaccctgaaacagatgctcaaactttgttgaacatcggagaatttatattggagagaaagtgtaaatgaatgtcaaaaaatatttgttcaaaaactacagtttagaaaacactagtttatactaaaaaaatatttttgcagatgcagtaaatggggaaaatatgtttaatcaaaaattaagtctacataaacatttgaggattcacagtagaaagaatgaaggtgctgaaacttcagacattacactaaatcagagtgttgagtgtaaaaaagatataaatctaacaatataaatttaaagaagtagatttatttggagatttataattacattcgaggtatgcttctttctttgtaaaaaaaaatatagattttctgaaaagcaaatagtaatgtaactcacatttcaaattacttcatgttgatcctttcttcccattgtttctgtgaaagtattggaccaattgttgaatcagagatatgagattgttttttataggtgtccattattcatgaactttcctatggatgagtaaggacattaagttgtaagatgcataatgaaaatctaaatggagaggttctttgtggttgacttataacattgttttagtgatgtataaggcgagcgttcagagtaatattctaaattctagtgaggaaaacctttgaacgtcagtagtaaattattttatcaattgtacctttatgtaaacaaagttgtttttaatgagctaaaactattgtgctttgaaagaagtattaagctgccattgactctatcgtgtctcatcttaaggttctgcgtaaaagatggtgacaatatactatttgttaatgtaggggaatgacatcactagtagtctcttttttgccagtgtttttgtttgtttgttttgagactaagtcttactctgtcacccagactggggtgcagtggtgcgatctcagctcactgcaacctccacctcctgggtccaagtgattctcctgcttcagcctcacaagtagctggaactagaggcaggcaccaccactcctggctaatttttgtatttttagtagagatgaggtttccccatgttggccaggctggtctcaaactcctgacctcaggtgatacacccacctcggtgtaccgaagtgctgggattacaggcatgagccaccatgcctggcctactagaggttttacacagcaaacaagttgaagaattttgttcccataggacaaatttgtacttttttaccttatttaatttttttttaatttttgtgggtagtgtgcatacacacttatggcatatatgagatatgttaacacatgcacataatatttaatgatcacaacagagtaaatgaggcattcatcaccttgagcatgtatttatcctttgtattacaaacaatcccattatacagttttagttatttcaatatgtgcaattgaattactattaaccacagggtcattttatgatcataaaaattacatgagtataattaatacccatacatttctgagtcttgattaaatatttttaaaattttgttttataaattttttgcacatgtggcatctctgctgacaaacaaaaacagacttttagtttcaatttacatagagttacatatacaaatatattactctaaagatataccagccgagcacagtggctcccagcattttgggagcctgaggtgggaggatcatttgaggttaggagttcaagaccagcctggccaacatggtgaaaccccatctctactaaaaatacaaaaaattagctgggcatggtggtgcatgcccatggtcccagttactcaggaggctgaggcaggagaattgcttgaacctcggaggtggaggtagcagtgagctgagatggtgctactgcactccagcctgggtgaaagagcgagaaaccatctcaaaaaaaaaaataaataaataaaagat

SEQ ID NO: 8760 - DNA, 3012 bp, Homo sapiens
ctatgtccctgcgggtcggtgcgagggcgaagaggaacccgtgggcccgggggatcccggggggccggaccagtgttccccagttgtgggagcagacgcgtgggcgcatcgcgggcgggcagggcctgaagtgcagctatgtttccagtgttctctggctgtttccaagagctacaagaaaagaataaatctctggggttggtgtcctttgaagatgtggctgtgcacttcacctgggaggagtggcaggacgtggatgatgcttagaggaccctgtacaggaacgtgatgctggagacctacaacagcctggtatcattacaggagttggtgtcctttgaggaggtagctgtgcacttcacctgggaggagtggcaggacctggatgatgctcagaggaccctgtacagggacgtgatgctggagacctacagcagcctggtatcattggggcattacattaccaaacctgagatgatcttcaagctagagcaaggagcagagccatggatagtagaagaaaccccaaacctgagactttcagctgtccagatcattgatgaccttattgaaaggagccatgaaagtcatgatagatttttctggcaaattgtaatcaccaacagcaacacatcaactcaggagagagttgaattaggaaaaacatttaatttgaactcaaaccatgttttaaatctgattataaataatggaaacagttcaggaatgaagcctgggcagtttaatgattgccagaacatgcttttccctattaagcctggggagacacagtctggagagaaacctcatgtctgtgatataaccaggagatcccacagacatcatgaacatcttactcagcatcacaagattcaaactctgctgcagacttttcaatgtaatgaacaagggaaaaccttcaacacggaggcaatgttctttatacataagagggttcatatagtacagacctttggtaaatataatgaatatgagaaagcctgtaataactcagctgttattgtccaagtgataactcaggtaggacagccaacttgctgtagaaagtctgacttcactaaacatcagcagacacacacaggagagaaaccctatgaatgtgttgaatgtgagaaaccctccattagcaaatcagaccttatgctacagtgcaagatgcctactgaggaaaaaccttatgcctgtaactggtgtgaaaaattgttcagctataagtccagcctcattatccatcagagaattcacacaggggaaaagccctatggatgcaatgaatgtggtaaaacctttcgccgtaagtcattcctcactttacatgagagaactcacacaggggataaaccctacaaatgtattgaatgtggaaaaacttttcactgtaagtcacttctcactttacatcacagaactcactcaggggaaaagccctatcagtgtagtgaatgtggaaaaacctttagccagaagtcatacctcacaatacatcatagaactcacacaggggaaaagccctatgcatgtgaccattgtgaagaagcatttagccataagtcaaggcttactgtccatcagagaacacacacaggggaaaaaccgtatgaatgtaatgagtgtggaaaaccctttatcaataagtcaaacctcaggttacatcagagaactcacacaggggaaaaaccctatgaatgcaatgaatgtgggaaaacgtttcaccgtaagtcattcctcactatccatcaatggactcacacaggggaaaaaccctacgaatgcaatgaatgtgggaaaacctttcgctgtaagtcattcctcactgtccatcagagaactcatgctggggaaaaaccatacgcatgtaacgaatgtggaaaaacatatagccacaagtcataccttacagtacatcacagaactcacacaggggaaaaaccctatgaatgtaatgaatgtggaaaatcctttcactgtaagtcattcctaactatacatcagagaactcatgctggcaaaaaaccctatgaatgtaatgaatgtgagaaaacctttatcaataagttaaaccttgggatacacaagagaactcacacaggggaaagaccctatgaatgtaatgaatgtggaaaaacctttcgtcagaagtcaaatctcagcacccatcagggaactcacacaggagagaaaccttacgtatgtaatgaatgtggaaaaacctttcatcgcaagtcattcctcaccatacaccagagaactcacacggggaaaaaccgtatggatgtaatgaatgtggaaaaactttttgtcagaaatcataccttattatacatcagagaactcacaccggggaaaagccctatgaatgtaatgaatgtggaaaatcctttcatcagaaggcaaatcttcagaagcatcaaggtattcacacgggggagaaaccctatgaatgtagcaaatgtggaaaaaccttgtcagaagtcagtcctcactgtacatcatagaacccataccggagaaaaaccttatgaatgtaatgagtgtgggaaaaccttttgtcacaagtcaaacctcagtacgcatcaggggactcactcaggagagaaaccctatgaatgtgatgaatgtaggaaaactttttacgataagacagttctcaccatacatcagagaactcacacaggtgagaagccatttgaatgtaaagaatgtaggaaaaccttctcccagaagtcaaaactctttgtacatcacagaactcacacaggggaaaaaccctttagatgtaatgaatgtaggaaaactttctcccagaagtcaggcctcagtatacatcagagaacacacacaggagaaaaaccttatgaatgtaaggaatgtgggaaaaccttttgccagaagtcacacctcagcaggcatcaacaaacccatataggagagaaatctgacgtagctgaggcaggctatgtgttccctcaaaatcactcttttttcccttga

SEQ ID NO: 8761 - DNA, 3068 bp, Homo sapiens
gtttgtattagttgggtttcccggtgtctctttagcaagtgaagtttctggttccctccttcactgtgtgacctgcctagtcctcctgggttgcgtttacagaagtttatacgagacctagtttccagggaagaactcactgatgccgcgagggagatggggtactggatgatggtcttcagccttaagggtacttcagtcttaaccgtgtgttataaggtttgaaagggagggttccctatgaataagaagcgcacttgaaagaacagccctctggtctaacctcccactggtgcttcagaggaggataaaaggtcacagctatgtttccagtgttctctggctgtttccaagagctacaagaaaagaataaatctctggagttggtgtcctttgaggaggtagctgtgcacttcacctgggaggagtggcaggacctggatgatgctcagaggaccctgtacagggacgtgatgctggagacctacagcagcctggtatcattggggcattacattaccaaacctgagatgatcttcaagctagagcaaggagcagagccatggatagtagaagaaaccccaaacctgagactttcagctgtccagatcattgatgaccttattgaaaggagccatgaaagtcatgatagatttttctggcaaattgtaatcaccaacagcaacacatcaactcaggagagagttgaattaggaaaaacatttaatttgaactcaaaccatgttttaaatctgattataaataatggaaacagttcaggaatgaagcctgggcagtttaatgattgccagaacatgcttttccctattaagcctggggagacacagtctggagagaaacctcatgtctgtgatataaccaggagatcccacagacatcatgaacatcttactcagcatcacaagattcaaactctgctgcagacttttcaatgtaatgaacaagggaaaaccttcaacacggaggcaatgttctttatacataagagggttcatatagtacagacctttggtaaatataatgaatatgagaaagcctgtaataactcagctgttattgtccaagtgataactcaggtaggacagccaacttgctgtagaaagtctgacttcactaaacatcagcagacacacacaggagagaaaccctatgaatgtgttgaatgtgagaaaccctccattagcaaatcagaccttatgctacagtgcaagatgcctactgaggaaaaaccttatgcctgtaactggtgtgaaaaattgttcagctataagtccagcctcattatccatcagagaattcacacaggggaaaagccctatggatgcaatgaatgtggtaaaacctttcgccgtaagtcattcctcactttacatgagagaactcacacaggggataaaccctacaaatgtattgaatgtggaaaaacttttcactgtaagtcacttctcactttacatcacagaactcactcaggggaaaagccctatcagtgtagtgaatgtggaaaaacctttagccagaagtcatacctcacaatacatcatagaactcacacaggggaaaagccctatgcatgtgaccattgtgaagaagcatttagccataagtcaaggcttactgtccatcagagaacacacacaggggaaaaaccgtatgaatgtaatgagtgtggaaaaccctttatcaataagtcaaacctcaggttacatcagagaactcacacaggggaaaaaccctatgaatgcaatgaatgtgggaaaacgtttcaccgtaagtcattcctcactatccatcaatggactcacacaggggaaaaaccctacgaatgcaatgaatgtgggaaaacctttcgctgtaagtcattcctcactgtccatcagagaactcatgctggggaaaaaccatacgcatgtaacgaatgtggaaaaacatatagccacaagtcataccttacagtacatcacagaactcacacaggggaaaaaccctatgaatgtaatgaatgtggaaaatcctttcactgtaagtcattcctaactatacatcagagaactcatgctggcaaaaaaccctatgaatgtaatgaatgtgagaaaacctttatcaataagttaaaccttgggatacacaagagaactcacacaggggaaagaccctatgaatgtaatgaatgtggaaaaacctttcgtcagaagtcaaatctcagcacccatcagggaactcacacaggagagaaaccttacgtatgtaatgaatgtggaaaaacctttcatcgcaagtcattcctcaccatacaccagagaactcacacggggaaaaaccgtatggatgtaatgaatgtggaaaaactttttgtcagaaatcataccttattatacatcagagaactcacaccggggaaaagccctatgaatgtaatgaatgtggaaaatcctttcatcagaaggcaaatcttcagaagcatcaaggtattcacacgggggagaaaccctatgaatgtagcaaatgtggaaaaaccttgtcagaagtcagtcctcactgtacatcatagaacccataccggagaaaaaccttatgaatgtaatgagtgtgggaaaaccttttgtcacaagtcaaacctcagtacgcatcaggggactcactcaggagagaaaccctatgaatgtgatgaatgtaggaaaactttttacgataagacagttctcaccatacatcagagaactcacacaggtgagaagccatttgaatgtaaagaatgtaggaaaaccttctcccagaagtcaaaactctttgtacatcacagaactcacacaggggaaaaaccctttagatgtaatgaatgtaggaaaactttctcccagaagtcaggcctcagtatacatcagagaacacacacaggagaaaaaccttatgaatgtaaggaatgtgggaaaaccttttgccagaagtcacacctcagcaggcatcaacaaacccatataggagagaaatctgacgtagctgaggcaggctatgtgttccctcaaaatcactcttttttcccttga

SEQ ID NO: 8762 - DNA, 2769 bp, Homo sapiens
ggcggcttccgggatttggcggtggcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatgggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagatatcttttctcatgatactcaaggcctcttaagaaagaagcttatagaagcatcattccaaaaagtgatattggatggatatgggagctgtggccctcagaatttaaacttaaggaaagagtgggaaagtgagggcaaaataatcctatggtgaaaaaaatcaacaagataatctctgcttgagaaaaaggaccaaagacaagtgaattttctgagggtgatgaaagtgttgcttcgaaaaggggtgaagtttatatgggtctatttatttgtctaacatgtacagttaaggtttatgccttgcaatgtatgtacatcttcacaaaaaaaatcttaaaaaaattaaatgggtgggggtagggaaagggttgaagtatagatgaagcagaagtggtacatgattagtagttgaagctgggggcaggtctatatattttatttttatgtctttaatagcatttgtataaatgtacaatattcgtttacaatgttagctcaggatcttgtttacctttggacagggagggagggagaaatttattttctgggtaggagtaaagctggttctattcctcagttatgtaaattatctgttataatccaaaaagctttacatgaatgtttctgtatgtaatgtggtatatcaataaaaaattaaatattacatatttgcaccagaatcctaactcactatctcagaatgttagcagcattttcttttgttgtaaagtggaacacaatctcatggcattagcagatgggtttgaatattctaaagtatcaacgtcctaatctcatgggcacctcttgggtctttccatttttgccttcatttgctaagtggcatgcttttgattttttgagatgaaactttttcccagcaaagtcttttccccacagtgatgctctgaaagccaggacacctagcacaggaccctgggcatagtatgcactcagtacatgtggagcatgttgatcaggaacaaaaggagtagcaaaggtcagttcctgcaaaggtgagtagataatacaggtatgactgaaaggctgcaactcaggagtaaacattttacattcattcaagagacaatttgcaactagtacaccaaaaaattttggcttgaagcagtactttggggacttggctaaactctgtaatcacttggagaactttaaacaatactgacgtctgggccctactccagggattttgattttattggtctgttgcaatttaggttttgggaattgtagggcctccgcatgtgactgtaatgtggagccaggggtgagacccactgtttcagggtgagggatgcattagctgtgtgtgatttccatgtgtgctgcaagtatttaacctatgaccactcctgcatttggagtcttggaaattgcagcaggaggaaatgtctctctacagatctattttttatgtcacttgcttttagagtaagaggttatttcaggcacagtaatttgatttaatctgttttcaaatactaaatctgaaaatactaaaatgaaaagaatttgcaaatgtgagaatttgcaaacatgtggagtgtgttcttatgtgctttccagtttctctgatgataagaaatgagtaatgttgggccttgatttcctaaactcagccctcagtcactttctcaaattatttgaagaccttccaagttgcttcagaagcattgtccaaaggagattattcccagtagtgaagaataatagatggatgagaatgtctaaggaatcctacttctgtcgcagaagtggcactctccagaacctcaagggcccatggagttcatgggctttggagtcaggcagagttgaccctgagtcccatcccagcctcttaatagactagttacttgacttggaacagttatgcaagacaaagcacaatgatactgattgcagtaatgggaacaattcattcctctctgtatccatgccctttgcaatgcatgtttttagctactcccatggagggaaagattctgtttttccagtccttggatctgactggccttatttgctgtggccaattcatacttactgttctagtgaaacaattaggcatgttttgctcctcattctagactttaattaaaattaaaattttatgatattttatttctactgtattttgctgtattcattctgctcagtattctagttcaccggtcctcttatctctgtttaatttagtggtgaacctatacattgtctggtaacttaattttgtattttcgtattctattgggctgtcgttcaaatgtggcttttaaacttcagttacttgttctttctacaaaaataaacattgattttcta

SEQ ID NO: 8763 - DNA, 1339 bp, Homo sapiens
agtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatggtgaatgtgccagatatcttttctcatgatactcaaggcctcttaagaaagaagcttatagaagcatcattccaaaaagtgatattggatggatatgggagctgtggccctcagaatttaaacttaaggaaagagtgggaaagtgagggtaagtgtgaaggtcacaatggatattatgatggacatacaaaatgtaagacaactacctataacaaaaacctcactgttacaggaggtcaaaaacatgaaaaaactcaatttatgtcagttgctttttctaaaccatgtgtttctgtaagtaagtgtcaacatcaatttttgaaacttaccttttcttttaaaggaaatttggataatccgaatagtgacttagtccatgtttcaaataatcatttaaaccaattaaaatatagaactggagtaaatgttcagtcaaatatttctgaaaaggagagatttaaaaacgaggaggtgatttctaaatatgatcaatttgatggatctttgttaaaagtttgtttcaccaacaaataacacctcgttctgcctgtgatcaatatagaaaggtcttcattcattcatcattgcttaatcaatgtcaaggaatagataatttgggaaaatatcacacacataataaaactttgacagcctttaggcaggactataccctaaataattaccagtatatttgtgttgcagagaaaaatcagtacaataaatctgatacaacattaagccaaggcataagccccagaagacatcagaaaactcattttctacataaccattgcaaacgtaaaaaatgtgagaaagcctttcatgaatgcaccaaccatgtccatcagagtatctttattcaagagaagtctgccaaatgtaataagtgtatagaaacttttatccagtcatcaaaacatactcagcctcagagaatccatattggagaaaagtcacacagatgtaataatggtgagaaaatccttagtaaattgtcaagtctaagaaaacataagataatccataatgaagagaaaccttacaaatgtaaagaatgtgacaaagcctttaaccatcgttcacaccttactcaacatcaaataattcatactggagagaaaccatacaaatgtaaagaatgtggcaaagccttcaattctagttcatattttacta

SEQ ID NO: 8764 - DNA, 2282 bp, Homo sapiens
ctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatgggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagaagtcaaagtgaatacccattaaacaacaaattgtcctttccacacttctctccagctcctgaagagcaccattctgcctaatgtttctatgagtttggctactgtagatactttatatatcttttctcatgatactcaaggcctcttaagaaagaagcttatagaagcatcattccaaaaagtgatattggatggatatgggagctgtggccctcagaatttaaacttaaggaaagagtgggaaagtgaggagaaaaatcagtacaataaatctgatacaacattaagccaaggcataagccccagaagacatcagaaaactcattttctacataaccattgcaaacgtaaaaaatgtgagaaagcctttcatgaatgcaccaaccatgtccatcagagtatctttattcaagagaagtctgccaaatgtaataagtgtatagaaacttttatccagtcatcaaaacatactcagcctcagagaatccatattggagaaaagtcacacagatgtaataatggtgagaaaatccttagtaaattgtcaagtctaagaaaacataagataatccataatgaagagaaaccttacaaatgtaaagaatgtgacaaagcctttaaccatcgttcacaccttactcaacatcaaataattcatactggagagaaaccatacaaatgtaaagaatgtggcaaagccttcaattctagttcatattttactagacatcagagaattcacactggagaaaaactttacaaatgtaaagcgtgtagcaaatgttttactcattcttcaaatcttcttgtgcatcagagaattcatactggagagaaaccttacaaatgtaaagaatgtggtaaatcatttaaagtgtcttcagcccttactcagcatgagagaattcatactggagagaaaccctataaatgtaaggaatgcagcaaagcctttaactgtaggtcgtacctaactaaacatcagagaattcataccggagaaaaactttacaaatgtaaatcatgtagcaaatctttttctcgttcctcaagtcttattgtccaccagagaattcatactggagaaaaaccctataaatgcaaagaatgtggcaaagcctttaattgtagttcacgccttactcaacatcaaagaattcataccggagagaaaccctacatatgtaaagaatgtggcaaagcctttaactgtagttcatcccttactaaacatcagagaattcatactggagtaaaactttacaaatgtaaagcatgtagcaaatctttctctcattcctcatgtctttctgtgcatcagataactcatactggaatgaaaccatatatatgtaaggattgtggcatctcctttaaccggtcttcaaaccttagacgacatcagatgattcatactggagagaaaccctacaaatgtaaagaatgtggcaaattatttaatcgatgctcaacccttactcgacataaaagtattcatactagagaatttctatagttgtagtaaatgtgaaaagagttttatccaaaatttagaacttaaaaatcaccatagagtttatagggaaaccgactttacagattgaataaatgggaggaagtatttaatcagaactcaaatctgaatgtgtcaggacttacacaaaaaaggactaaagcacagatccccactttaaaattaaataagagtatttgttatggaggattactctaaagccaaagcagttacttattttgttatgtgtttcaaatgagcaaaagcattgatgtttggacaagtaattattcagtgagcatgttatttgtattgaaaacatttgaaatttgtataaagcaaatcataatttaattctcagattagttgttatacctt

SEQ ID NO: 8765 - DNA, 2764 bp, Homo sapiens
ctcgtcttccctgctttgtgtcccctgctcttagaggcccagcctctgtggccctctgacctgcaagcattgggagatccacagctaagacgccagggcctcccctggaagcctagaaatgggaccattgacatttatggatgtggccatagaattctctgtggaggagtggcaatgcctggacactgcacagcagaatttatataggaacgtgatgttagagaactacagaaacctggtcttcctgggtattgctgtctctaagccagacctgatcacctgtctggagcaaggcaaagagccctggaatatggagagacatgagatggtggccaaacccccaggtatgtgttgttattttgcccaagaccttcggccagagcagagcataaaagcttctttgcaaagaataatactgagaaaatatgaaaaatgtggacatcacaatttacagttaaaaaaaggctataaaagtgtggatgagtacaaggtgcacaaaggaagttataatggatttaaccagtgtttgacaactacccagagcaaaatatttcagtgtgataaatatgtgaaagactttcataaattttcaaattcaaatagacataagactgaaaagaatcctttcaaatgtaaagaatgtggcaagtcattttgtgttctttcacacctaactcaacataaaagaattcacactactgtcaattcctacaaacttgaagaatgtggcaaggcctttaatgtgtcctcaaccctttctcaacataagagaattcatacaggacaaaaacactacaaatgtgaagaatgtggcatagcctttaacaagtcctcacaccttaacacacataagataattcatactggagagaaatcctacaaacgtgaagaatgtggaaaagcttttaacatatcctcacaccttactacacataagataattcatactggagagaatgcctacaaatgtaaagaatgtggcaaagcttttaaccaatcatcaacccttactagacataagataattcatgctggagagaagccctacatatgtgaacattgtggcagagcttttaaccaatcctcgaaccttactaaacataagagaattcatactggtgataaaccttataaatgtgaagaatgtggcaaagcctttaatgtgtcctcaacccttactcaacataagagaattcatactggagagaaaccttacaaatgtgaagagtgtggcaaagcctttaacgtgtcctcaactcttactcaacataagagaattcatactggagaaaaaccatacaaatgtgaagaatgtggcaaagcctttaacacatcctcacacctcaccacacataaaagaattcataccggagagaaaccctacaaatgtgaagaatgtggcaaagcctttaaccagttctcacaacttactacacataagataattcatactggagagaaaccctacaaatgtaaagaatgtggcaaagcttttaagcggtcctcaaaccttactgaacataggataattcatactggagagaaaccctacaaatgtgaagaatgtggcaaagcttttaacctatcctcacaccttacaacacataagaaaattcatactggagagaaaccctacaaatgtaaagaatgtggcaaagcttttaaccaatcctcgacacttgctagacataagataattcatgctggagagaaaccctacaaatgtgaagaatgtggcaaagctttttaccaatactcaaaccttactcaacataagataattcatactggagagaaaccctacaaatgtgaagaatgtggcaaagcctttaattggtcctcaactctgactaaacataaggtaattcatactggagagaaaccctacaaatgtaaagaatgtggcaaagcttttaaccaatgctcaaaccttactacacacaagaaaattcatgctgtagaaaaatctgacaaataagaaaaatggaccaggcgtggtggctcacacctgtaatcccagcactttgggaggccaaggcgggtggatcacaagatcaagagattgagaccatcctggccaacgaagagaattactggagagaaaccgtacaaacctgaaagatataacagtgcagttgacaacacctcaatatttctaaacacctttaaatggttgtcatacttgattgtaggtaaaatatagtagaggaaacctctacaagtgtgaagaatgtggcaaaacttttaaccaatgctgacactttattggacaggaaatgatgtatacttgagaaaaattatgcaaatgtaaagaatgtgaagaagccattaatatctgttcacatcttattcaatatcagagagttcatacttaatagaagcattaaagatgaaattactgtcaatagatttttcagaaaatataagcctttaaagtgaagaagagtatttattttgaagacaagcattaaaatatcaagagtgtaagctgggcatggtggctcaggcctgtaatttcagcactttggaggccaaggcaggtggtttacttgaggtcagaagttcaagaccagcctggccaacatggtgaaactccatctctacccaaaatacaaaaattaggtgggtgtggtagtgcatgactaatcccagctactcggtggttgagacaggagaatcgcttgaacctgggaggcagaggttgcagtgagctgagtttgtgccaccacactccagcctgggcactccagctgcactccatctc

SEQ ID NO: 8766 - DNA, 1679 bp, Homo sapiens
aatatggcaaggccttcgtctcctagcttctaggctctgagtccagtacccgtctgtactattccatctcttccgctccattagctcctcggtgactccaccatagcccctgttatcctgtgacctgcaggtactgggagatccatagggaagaaggcggaacatccggaggctgggaaatgcgagtgctaacattcagggatgtggctgtagaattctccccagaagagtgggaatgcctggactctgctcagcagcgtttgtatagggatgtgatgttagagaactacggaaacctgttctccttgggtcttgctatctttaagccagacttgattacctatctggagcaaagaaaagagccttggaatgcgaggagacagaagacagtagccaaacacccagctggctctttgcattttactgcagagatattgctggagcacgacataaacgattcatttcaaaaagtgatcctgagaaaatctggaagctgtgaccttaatactttacgtttaaagaaagactaccaacgtgtgggtaattgcaaggggcagaaaagcagttataatggcattcatcaatgtttgtcagctacccgtagcaaaacctgtcaatataataaatgtggcaaagcttttgggttgtgctcaatcttcactgaacataagaaaatttttagcagagagaaatgctacaaatgtgaagaatgtggcaaagactgtaggttgtcagattttaccatacagaagagaattcatactgcagatagaagttacaaatgtgaagaatgtggcaaagcctgtaaaaagttctcaaaccttactgaacataatagagttcatactggaaagaaaccctacaaatgtgaagaatgtggcaaaacatttacctgttcctcagcccttactaaacacaagagaaatcatactggagacagaccctacaaatgcgaagaatgtcacaaagcctttaggtgttgctcagaccttactaaacataagagaattcatactggagagaaaccctacaaatgtaaagaatgtcacaaagcctttaggtgttgctcagaccttactaaacataagagaattcatactggagagaaaccctacaaatgtaatgaatgtggaaaagcttttatgtggatctcggcccttagtcaacataacagaattcatactggagagaaaccctacatttgtgaagaatgtggcaaagcctttacctactcctcaacccttattagccacaagagaattcatatggaattgagaccttacaaatgtgaagaatgtggcaaaacctttaagtggttctcagacctgactaatcataagagaattcacactggagagaaaccctacaaatgtgaagaatgtggcaaaagctttacctgctcctcaaaccttattaaacacaagagaattcatatggaagtgagaccttacaaatgtgaagaatgtggcaaaacctttaagtggttcccagacctgactaatcataagagaattcacactggagagaagccctacaaatgtgaagaatgtggcaaaacctttacctgctcctcaagccttattaaacacaagagaagtcatactggagacagacctacaagtgcaaagaatgtggcaaagcctttaggtggttctcagaccttactaaacataaggtaa

SEQ ID NO: 8767 - DNA, 2015 bp, Homo sapiens
gttggctctcgctgcacgcggaggtcaaggtgtcgtccttactgctgtgtgtcgtccgctcctaaaggcccagcttctatggccctgtgacctgcaggtattgggagattcacaactaagtcgccaggacccccggaagcctagaaatgggatcgttgacatttcgggatgtggccatacaattctctctggaggagtggcaatgcctggacactgcacagcagaatttatataggaatgtgatgttagagaactacagaaacctggtcttcctgggtattgctgcccctaagccagacctgatcatttttctggagcaaggaaaagagccctggaatatgaagagacatgagctggtgaaagaaccgccagttatatgttctcattttgctcaagacctttggccagagcagggcagagaagattctttccaaaaagtgatattgagaagatatgaaaaatgtggacatgagaatttacagttaaaaattggttgtaccaatgtggatgagtgtaaggtgcacaaaaaaggttataataagcttaaccagagtttgacaactacacaaagcaaagtatttcaatgtggcaaatatgcaaacatctttcataaatgttcaaattcaaaaagacataagataaggcatactggaaagaaacttttgaaatgtaaagaatatgtcagatcattttgcatgctttcacacctatctcaacataaaagaatttatactagagagaattcctacaaaagtgaagaacatggcaaagcctttaactggtcctcagcccttacttataagagaattcatactggagagaaaccctgcaaatgtgaagaatgtggcaaagcctttagtaagttctcaatccttactaagcataaggtaattcatactggagagaaacattacaaatgtgaagaatgtggcaaagccttcacccggtcctcaagccttattgaacataagagaagtcatgctggagagaaaccctacaaatgtgaagaatgtggcaaagcctttagtaaggcctcaacccttactgcacataagacaattcatgctggagagaaaccctacaaatgtgaagaatgtggcaaagctttcaaccggtcctcaaaccttatggaacataagagaattcatactggagagaagccctgcaaatgtgaagaatgtggcaaagcctttggtaacttctcaacccttactaaacataaggtaattcatactggagagaaaccctacaaatgtgaagaatgtggcaaagccttcagctggccctcaagccttactgaacacaagagaattcatgctggagacaaaccttacaaatgtgaagaatgtggcaaaacctttaagtggtcctcaacacttactaaacataagataattcatactggagagaaaccctacaaatgtgaagaatgtggcaaagcctttactacattttcgagccttactaaacataaagtaattcatactggagagaaacactacaaatgtgaagaatgtggcaaagtcttcagctggtcctcaagccttactacacataaggcaattcatgctggagagaaactctacaaatgtgaagaatgtggcaaagcctttaagtggtcctcaaaccttatggaacataagagaattcatactggagagaaaccctacaaatgtgaagaatgtggcaaagccttcagtaaggttgcaaaccttactaaacataaggtaattcatactggagagaaacaatacaaatgtgaagaatgtggcaaagccttcatctggtcctcaagacttagtgaacataagagaattcatactggagagaaaccctacaaatgtgaagaatgtggcaaagcctttagctgggtctcagtccttaacaaacataagaaaattcatgctggaaagaaattctacaaatgtgaagaatgtggtaaagacttcaaccaatcctcacaccttactactcataagagaattcatactggaggaaaaaccctacaaatgtga

SEQ ID NO: 8768 - DNA, 3595 bp, Homo sapiens
ggtctcgccttcactgctgtgtgtcctcagcctctgtggccctgtaacctgcggcattggaagatccacagctaacatgccaggtgcccctggcagcctagaaatgggaccattgacatttagagatgtgaccatagaattctctctggaggagtggcaatgcctggacacggttcagcagaatttatatagggatgtgatgttagagaactacagaaacctggtcttcctgggtatggctgtctttaagccagacttgataacttgtctgaagcaagggaaagagccttggaatatgaagagacatgagatggtaactaaacccccagttatgcgttctcattttacacaagacctttggccagatcagagcacaaaagattctttccaagaagtaatactgagaacatatgcaagatgtggacataagaatttacgattaagaaaagattgtaaaagtgccaatgagggtaagatgcacaaagaaggttataataaacttaaccaatgcaggacagctacccagagaaaaatatttcagtgtaacaaacatatgaaagtctttcataaatattcaaatagaaataaggttagacacactaaaaagaaaactttcaaatgtataaaatgtagcaaatcatttttcatgctttcatgcttaattcgacataagagaattcatattagacagaatatctacaaatgtgaagaacgtggcaaagcctttaaatcgttctcaacccttactaaacataagataattcatactgaagacaaaccttacaaatataagaaatgtggcaatgcctttaaattttcttcaacgttcactaaacataagagaattcatactggagagacacctttcagatgtgaagaatgtggcaaagcttttaaccagtcctcaaatcttactgaccataagagaattcatactggagagaaaacctacaaatgtgaagaatgtggcaaagcttttaaggggtcctcaaattttaatgcacataaggtaattcatactgcagagaaaccctacaaatgtgaagattgtggcaaaacttttaaccatttctcagcccttagaaaacataagataattcatactggaaagaaaccctacaagcgtgaagaatgtggcaaagcttttagccagtcctcaacccttagaaaacatgagataattcatactggagagaaaccctacaaatgtgaagaatgtggtaaagcttttaagtggtcttcaaaacttactgtacataaggtagttcatactggagagaaaccctacaaatgtgaagaatgtggcaaagcttttagccagttctcaacccttaaaaaacataagataattcatactggaaagaaaccctacaaatgtgaagaatgtggcaaagcttttaacagttcctcaacccttatgaaacataagataattcatactggggagaaaccatacaaatgtgaagaatgtggcaaagcttttaggcaatcctcacaccttactagacataaagcaattcatactggagagaaaccctacaaatgtgaagaatgtggcaaagcttttaaccatttctcagaccttagaagacataagataattcatactggaaagaaaccctacaaatgtgaagaatgtgggaaagcttttagccagtcctcaacccttagaaaccatcagataattcatactggagagaaaccctacaaatgtgaagaatgtggtaaagcttttaagtggtcatcaaaacttactgtacataaggtaattcatactggagagaaaccctgcaaatgtgaagaatgtggcaaagcttttaagcatttctcagccctcagaaaacataaggtaattcatactagggagaaattgtacaaatgtgaagaatgtggcaaagcttttaacaattcctcaatccttgctaaacataagataattcatactgggaagaaaccgtacaaatgtgaagaatgtggcaaagcttttaggcaatcctcacaccttactagacataaagcaattcatactggagagaaaccttacaaatgtgaagaatgtggcaaagcttttagccatttctcagcccttagaagacataagataattcatactggaaagaaaccgtacaaatgtgaagaatgtggcaaagcttttagccatttctcagcccttagaagacataagataattcatactggagagaaaccctacaaatgtgaagaatgtggtaaagcttttaagtggtcatcaaaacttactgtacataaggtaattcatactgcagagaaaccctgcaaatgtgaagaatgtggcaaatcttttaagcatttctcagcccttagaaaacataaggtaattcatactagggagaaattgtacaaatgtgaagaatgtgtcaaagcttttaacagtttctcagcccttatgaaacataaggtaattcatactggagagaaaccctacaagtgtgaagaatgtggtaaagcttttaagtggtcctcaaagcttactgtacataaggtaattcatactggagagaaaccctgcaaatgtgaagaatgtggcaaagcttttaagcatttctcagcccttagaaaacataaggtaattcatactggaaagaaaccctacaaatgtgaagaatgtggcaaagcttttagccaatcctcatcccttagaaaacatgagataattcatagtggagagaaaccatacaaatgtgaagaatgtggtaaagcttttaagtggttgtcaaaacttactgtacataagataattcatactggaaagaaaccctacaaatgtgaagaatgtggcaaagcttttaatgattcctcaacccttatgaagcataagataattcatactgggaagaaaccatacaaatgtgcagaatgtggcaaagcttttaagcaatcctcacatcttactagacataaagcaattcatactggggagaaaccctacaaatgcgaagaatgtggcaaagattttaacaattcctcaacccttaagaaacataagctaattcatactagggagaaattgtacaaatgtgaagaatgtgtcaaagcttttaacaatttctcagcccttatgaaacataagataattcatactggggagaaaccctacaaatgtgaagaatgtggtaaagcttttaagtggtcctcaaaacttactgaacataaggtaattcatactggagagaaaccctgcaaatgtgaagaatgtgacaaagcttttaagcatttctcagcccttagaaaacataaggtaattcatactggaaagaaaccctaccaatgtgacgaatgtggcaaagcttttaacaattcctcaacccttacgaaacataagataattcatactggggagaaaccctacaaatgtgaagaatgtggcaaagcctttagtcagtcctcaatccttactaaacataagataattcattctgtagagaaaccctacaaatgtgaagaatgtggcaaagcctttaaccagtcctcacaccttactagacacaaaacaattcatactggagagaaaccctacaaatacaaaacaattcatactggagagaaaccctacaaa

SEQ ID NO: 8769 - DNA, 3877 bp, Homo sapiens
gatgtggcggggccgttgtttctggttgcagccgcagttcccggtctcgccttcactgctgtgtgtcctcagcctctgtggccctgtaacctgcggcattggaagatccacagctaacatgccaggtgcccctggcagcctagaaatgggaccattgacatttagagatgtgaccatagaattctctctggaggagtggcaatgcctggacacggttcagcagaatttatatagggatgtgatgttagagaactacagaaacctggtcttcctgggtatggctgtctttaagccagacttgataacttgtctgaagcaagggaaagagccttggaatatgaagagacatgagatggtaactaaacccccagttatgcgttctcattttacacaagacctttggccagatcagagcacaaaagattctttccaagaagtaatactgagaacatatgcaagatgtggacataagaatttacgattaagaaaagattgtaaaagtgccaatgagggtaagatgcacaaagaaggttataataaacttaaccaatgcaggacagctacccagagaaaaatatttcagtgtaacaaacatatgaaagtctttcataaatattcaaatagaaataaggttagacacactaaaaagaaaactttcaaatgtataaaatgtagcaaatcatttttcatgctttcatgcttaattcgacataagagaattcatattagacagaatatctacaaatgtgaagaacgtggcaaagcctttaaatcgttctcaacccttactaaacataagataattcatactgaagacaaaccttacaaatataagaaatgtggcaatgcctttaaattttcttcaacgttcactaaacataagagaattcatactggagagacacctttcagatgtgaagaatgtggcaaagcttttaaccagtcctcaaatcttactgaccataagagaattcatactggagagaaaacctacaaatgtgaagaatgtggcaaagcttttaaggggtcctcaaattttaatgcacataaggtaattcatactgcagagaaaccctacaaatgtgaagattgtggcaaaacttttaaccatttctcagcccttagaaaacataagataattcatactggaaagaaaccctacaagcgtgaagaatgtggcaaagcttttagccagtcctcaacccttagaaaacatgagataattcatactggagagaaaccctacaaatgtgaagaatgtggtaaagcttttaagtggtcttcaaaacttactgtacataaggtagttcatactggagagaaaccctacaaatgtgaagaatgtggcaaagcttttagccagttctcaacccttaaaaaacataagataattcatactggaaagaaaccctacaaatgtgaagaatgtggcaaagcttttaacagttcctcaacccttatgaaacataagataattcatactggggagaaaccatacaaatgtgaagaatgtggcaaagcttttaggcaatcctcacaccttactagacataaagcaattcatactggagagaaaccctacaaatgtgaagaatgtggcaaagcttttaaccatttctcagaccttagaagacataagataattcatactggaaagaaaccctacaaatgtgaagaatgtgggaaagcttttagccagtcctcaacccttagaaaccatcagataattcatactggagagaaaccctacaaatgtgaagaatgtggtaaagcttttaagtggtcatcaaaacttactgtacataaggtaattcatactggagagaaaccctgcaaatgtgaagaatgtggcaaagcttttaagcatttctcagccctcagaaaacataaggtaattcatactagggagaaattgtacaaatgtgaagaatgtggcaaagcttttaacaattcctcaatccttgctaaacataagataattcatactgggaagaaaccgtacaaatgtgaagaatgtggcaaagcttttaggcaatcctcacaccttactagacataaagcaattcatactggagagaaaccttacaaatgtgaagaatgtggcaaagcttttagccatttctcagcccttagaagacataagataattcatactggaaagaaaccgtacaaatgtgaagaatgtggcaaagcttttagccatttctcagcccttagaagacataagataattcatactggagagaaaccctacaaatgtgaagaatgtggtaaagcttttaagtggtcatcaaaacttactgtacataaggtaattcatactgcagagaaaccctgcaaatgtgaagaatgtggcaaatcttttaagcatttctcagcccttagaaaacataaggtaattcatactagggagaaattgtacaaatgtgaagaatgtgtcaaagcttttaacagtttctcagcccttatgaaacataaggtaattcatactggagagaaaccctacaagtgtgaagaatgtggtaaagcttttaagtggtcctcaaagcttactgtacataaggtaattcatactggagagaaaccctgcaaatgtgaagaatgtggcaaagcttttaagcatttctcagcccttagaaaacataaggtaattcatactggaaagaaaccctacaaatgtgaagaatgtggcaaagcttttagccaatcctcatcccttagaaaacatgagataattcatagtggagagaaaccatacaaatgtgaagaatgtggtaaagcttttaagtggttgtcaaaacttactgtacataaggtaattcatactgcagagaaaccctgtaaatgtgaagaatgtggcaaagcttttaagcatttctcagcccttagaaaacataagataattcatactggaaagaaaccctacaaatgtgaagaatgtggcaaagcttttaatgattcctcaacccttatgaagcataagataattcatactgggaagaaaccatacaaatgtgcagaatgtggcaaagcttttaagcaatcctcacatcttactagacataaagcaattcatactggggagaaaccctacaaatgcgaagaatgtggcaaagattttaacaattcctcaacccttaagaaacataagctaattcatactagggagaaattgtacaaatgtgaagaatgtgtcaaagcttttaacaatttctcagcccttatgaaacataagataattcatactggggagaaaccctacaaatgtgaagaatgtggtaaagcttttaagtggtcctcaaaacttactgaacataaggtaattcatactggagagaaaccctgcaaatgtgaagaatgtgacaaagcttttaagcatttctcagcccttagaaaacataaggtaattcatactggaaagaaaccctaccaatgtgacgaatgtggcaaagcttttaacaattcctcaacccttacgaaacataagataattcatactggggagaaaccctacaaatgtgaagaatgtggcaaagcctttagtcagtcctcaatccttactaaacataagataattcattctgtagagaaaccctacaaatgtgaagaatgtggcaaagcctttaaccagtcctcacaccttactagacacaaaacaattcatactggagagaaaccctacaaatgtgaagaatgtggcaaagcttttattcagtgctcataccttattagacataaaacaattcataccagagagaaacctacaaatgtgaagaaagtaccaaagcttttaagcaatcctcacaccttactagacaaaacaattcatactggagagaaaccctacaaatgtgaagaatgtgccaaagctttttaa

SEQ ID NO: 8770 - DNA, 3462 bp, Homo sapiens
ggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagcagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcaaaacagtccttgcatctttcctgtctttaggtacgcaccatctttgctgtctttaagtatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctccctcagcttttctggggcgggttgactcgtgtgtcactttatcacaggggcacatggggtgagaagaggaaccttggcagtaggagatacctttgtaccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattaccta

SEQ ID NO: 8771 - DNA, 3504 bp, Homo sapiens
gggggcgtcgtcgtgggtacaattgcgcaggggcaaaggtcgagaggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcaaaacagtccttgcatctttcctgtctttaggtacgcaccatctttgctgtctttaagtatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctccctcagcttttctggggcgggttgactcgtgtgtcactttatcacaggggcacatggggtgagaagaggaaccttggcagtaggagatacctttgtaccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattaccta

SEQ ID NO: 8772 - DNA, 1515 bp, Homo sapiens
tttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggagtcggaggcagcaagccggcgctcatctcctgggtggaggagaaggccgaactgtgggatccggctgcccaggatccggaggtggcgaagtgtccgacagaagcggacccagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggcaacatgagtgagaatgaggaagaggaaatttctcagcaagaaggcagtggggactatgaagtcgaagagataccatttgggcttgaaccccagagccctgggtttgagccacaaagcccagagtttg

SEQ ID NO: 8773 - DNA, 3233 bp, Homo sapiens
ccctggctccccttggaagcacagcccgcgtccctggaacccgggctgcactgagctggtcacatgaactccgggctttctctggtgtgacgggtttcttagatccctttgtgagcgcaggttttgaaagggaacgaccccgggttctgggtgtgagaggcgcaggggatcggcgggaggaaggctgtcggagccaatcaagccgcctccagaccccagcacgtcgcctgggctgcgcgctccgactgcgcctccgcccgcgcgcctcccggcctcgcccgagggtgcctgggcaggcgaggaccccaggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggccggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccaggactcagagctgggtgacccctgtggggaacagccagacctggacatgcaggagccagagaacacgctggaggagtccacggaaggctccagcgagttcagcgaactgaagcagatgctggtgcagcagaggaactgcacggaggggatcgtgatcaagacagaggaacaagacgaggaggaagaagaggaggaggaggatgagctgccgcagcacttgcaatcccttgggcagctgtccgggagatatgaggccagtatgtaccagaccccgctgcccggggagatgtcccccgagggcgaggagagccccccgcccctgcagctaggaaaccccgcagtgaaaaggctggcgccctccgtgcacggtgagcggcacctgagcgagaaccgcggggcctcgagccagcagcagcggaaccggcgcggcgagcggcccttcacatgcatggagtgcggcaagagcttccgcctgaagatcaacctcatcatccaccagcgcaaccacatcaaggaggggccctacgagtgcgccgaatgcgagatcagcttccggcacaagcaacagctcacgctgcaccagcgcatccaccgcgtgcgcggaggctgcgtctcacccgaacgcgggcccacgttcaaccccaagcacgcgctcaagccgcgtcccaagtcacccagctctggtagcggcggcggtggccctaagccctacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgcacgcctgccccgagtgcggcaagagcttcatccgcaagcaccacctcctggaacaccggcgcatccacacaggcgagcggccctaccactgcgccgagtgcggcaagcgcttcacgcagaagcatcacctgctggagcaccagcgcgcgcacacgggcgagcggccctacccctgcacgcactgcgccaagtgcttccgctacaagcagtcgctcaagtaccacctgcggacccacacgggcgagtgagcgcgcgccccgccgccgccgcccggccaggtgcgcgggccgtgccccccctcggacaccgccaggcccgagcccagcgggcgggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaatttttaaaagaa

SEQ ID NO: 8774 - DNA, 1655 bp, Homo sapiens
gtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccaggactcagagctgggtgacccctgtggggaacagccagacctggacatgcaggagccagagaacacgctggaggagtccacggaaggctccagcgagttcagcgaactgaagcagatgctggtgcagcagaggaactgcacggaggggatcgtgatcaagacagaggaacaagacgaggaggaagaagaggaggaggaggatgagctgccgcagcacttgcaatcccttgggcagctgtccgggagatatgaggccagtatgtaccagaccccgctgcccggggagatgtcccccgagggcgaggagagccccccgcccctgcagctaggaaaccccgcagtgaaaaggctggcgccctccgtgcacggtgagcggcacctgagcgagaaccgcggggcctcgagccagcagcagcggaaccggcgcggcgagcggcccttcacatgcatggagtgcggcaagagcttccgcctgaagatcaacctcatcatccaccagcgcaaccacatcaaggaggggccctacgagtgcgccgaatgcgagatcagcttccggcacaagcaacagctcacgctgcaccagcgcatccaccgcgtgcgcggaggctgcgtctcacccgaacgcgggcccacgttcaaccccaagcacgcgctcaagccgcgtcccaagtcacccagctctggtagcggcggcggtggccctaagccctacaagtgccccgagtgcgacagcagcttcagccacaagtccagcctgaccaaacaccagatcacgcacacgggtgagcggccctacacgtgccccgacgccgccgcccggccaggtgcgcgggccgtgccccccctcggacaccgccaggcccgagcccagcgggcggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaattttt

SEQ ID NO: 8775 - DNA, 3142 bp, Homo sapiens
acaaacgcggcggaaccggttgcggggaggttgcttgaattctctcagctgcgccccctgacctagtagtcgctggcacaagctgcgcccggagacgtgggagcgttctcttgttttccgagtgcgcggactcatcgggtcacagtttatgcttttatgacgcgggaacacaacagatttgagaagcctcggattaaggaataatttatgaagctccgttgactaccgtggagagatcataatttggggttcaagattccagtctgtgtttttccagaggtgccctgaggagcagggaagcatggctattgtggatgtaaaagccatgttcaagatatgctgtctagatatgagaccaaggagttaactcttaagaatggcacttttgaaaaggaatcattaaaatggaaaataatagaaagtgtcagaagttcttgccttgaggaatcttttttgggaaatgattggaaatgcaaaggactctttgagagacaacaggaaactacagaggaatatttcaggcatgtaactgtgccatttgaaaaaatatccgaattcatccagcctacatattttcttctaaatcaaataattcatactggaaagaaactctatgaacaaaaaaaaaaatgagaaaatgttactcaacagggaagaattcatatcagtgacaagcttgacgaaatgtgtgggaacacctctgtattttgcacaaatcatatgaaacatcagacaaattttaatgcaaagaaatgcaatgtatttaaagaatgtggcagagactgcttgtaactttcaactaactcaatatcaaataagtcatgctaatcagaaaccctatgaatgtcagatatgtggaaagccctttagaaagcgtgcccaccttacccaacataatcgaattcacactggtgggaaaccatatgaatgcaaagaatgtgggaaagtgtttatctgttgttcaacattgattcaacataagagaactcacactagtgagaaaccctatgaatgtctggaatgtagaaagacgtttaggcggagtgcacatcttattcgacatcaaagaattcatactggtgagaaaccttataaatgtaagcaatgttggaaggcctttgcttctgtttctgatttaatagacatcggaaaattcacactgatgagagactttacgaatgtacagaatgtgggaaggcatttaacaatcgctcaactcttattcagcatcagagaattcacactggtgagaagtcctttgaatgtaaggaatgtggcaaagcattcaataattgctcaacacttactcaacaccagagaactcatactaatgagaaatcttatgaatgtcaggaatgtaaaaaggcttttaggcaaagtgcacatcttactcaacatcaaagaattcatactggtgagaaaccatatgagtgtaagtaatgtgggaaggctttcacttgtgtttctgattttaatagacatcagagaattcacactggtgaaaaaccctatgaatgtaaagaatgtggtagagcttttaacaattgttcagctcttattcaacaccagagaattcacactggtgagaaggcttatgaatataagcagtgtgggaaggtttttgtctcctgtccaacacttgttcaacatcagagaacacatactaatgaaaaaccttatgaatgtcagtaatgcaagaaggccttcaagcataatgcacatctaatgagacatcagagaattcacagtggggagaaaccctatgaatgtaatgaatgtgggaatgccttcatttgtttttttgattttaatagacatcagagaattcacaaaggagagaaaccctatcagtgtaaagaatgtgggaaggtttttaataattatccaactcttactcaacatcaaagaattcataccagtgtgaaaccctatgaatgtaaggaatgtgtaaagacctttacttggctttcaaacttgaataaacatcagacaattcacactggtgacaaaccctatgaatgtaaagattgtaaaaaagcttttctttgttattcaacatttattcaacactatagaactcatactaatgagaaacctatgaatgtcaggaatgcagcaaggcctttaagcagagagcccatcttagtcaacatcaaaatattcatactggtgagaaaccctatgagtttaaggaatgtgggaaggcctttgcttgtttcctaccttaatagaaatcagagaattcacactagtgagaaaccgtatcagtgtaaaaaatgtagaaaatcctttattgattgttcaactcttaacaccagagaattcacactggtgagaaaccctttgaatgtcaggaatgtaggaaggcctttaggcagagggcgcatcttactcaacatcaaagaattcctactggtgagaaaccctatgaatgtaatgaatgtgagaaggcctcttcttgtctttcataggtgaaaaagcaccagagaatacatacatgaagggacaaatcttatgtatttgaatagcgtctttttatttaacaatccttatctaacatcaccaaattcacattgcagagaaacttcagaaatataagaaatgtgggaaacacttttacctgtccctcagctatactttttcataacagaatttgtacaggtgagaagcctaatgaaagcccgatatgtgtaaagatctactctcacaatatactcaacattatataatgtatagtgtgattaatataggaaatccttgattttgaaattatcaattatggaatagcaaacaatttgtaagtgaagaaaatccagtgactgtaaatttttttacctcataattcacaatttattaagcatcagaatttatatggaaaaaatagaatatcaattattaataaaaacattaccactaaaattttatttgacttatagagaatagcatatagagaataatcatgttgactttgtgaatgtagaaaagcttttatctattacacgaatctttttcagcatcattatactttcaccagtttccacgtctgttttattaccaagtaatttaaactgtatacttcagattacaaatttcttacattgtgataaggttattgtgaagattaaatgagtttatccaaaga

SEQ ID NO: 8776 - DNA, 1059 bp, Homo sapiens
atgcaaagaaatgcaatgtatttaaagaatgtggcagagactgcttgtaactttcaactaactcaatatcaaataagtcatgctaatcagaaaccctatgaatgtcagatatgtggaaagccctttagaaagcgtgcccaccttacccaacataatcgaattcacactggtgggaaaccatatgaatgcaaagaatgtgggaaagtgtttatctgttgttcaacattgattcaacataagagaactcacactagtgagaaaccctatgaatgtctggaatgtagaaagacgtttaggcggagtgcacatcttattcgacatcaaagaattcatactggtgagaaaccttataaatgtaagcaatgttggaaggcctttgcttctgtttctgatttaatagacatcggaaaattcacactgatgagagactttacgaatgtacagaatgtgggaaggcatttaacaatcgctcaactcttattcagcatcagagaattcacactggtgagaagtcctttgaatgtaaggaatgtggcaaagcattcaataattgctcaacacttactcaacaccagagaactcatactaatgagaaatcttatgaatgtcaggaatgtaaaaaggcttttaggcaaagtgcacatcttactcaacatcaaagaattcatactggtgagaaaccatatgagtgtaagtaatgtgggaaggctttcacttgtgtttctgattttaatagacatcagagaattcacactggtgaaaaaccctatgaatgtaaagaatgtggtagagcttttaacaattgttcagctcttattcaacaccagagaattcacactggtgagaaggcttatgaatataagcagtgtgggaaggtttttgtctcctgtccaacacttgttcaacatcagagaacacatactaatgaaaaaccttatgaatgtcagtaatgcaagaaggccttcaagcataatgcacatcgacatcagagaattcacagtggggagaaaccctatgaatgtaatgaatgtgggaatgccttcatttgtttttttgatt

SEQ ID NO: 8777 - DNA, 1967 bp, Homo sapiens
ctcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcactttggagaatcttcccttagaagtaaaagctccaatacataaaagacagatgaacatgtgaacatggacatttattgtaaaaattgttcttaatggcaaaaaaacccccaaaaccaaagcaaacactagaatcaaagtaaatacccatcaactgggaaattgtagaaaggaaaaaactatagtgtatccattccatagaatgttaatatagccattaaggtggacaaattaaaactatgctagtggacttgagtggaattccacaatgttctcttgagtgaaaaatgcaaggtagatattaagtatgttaaatatgactccatttttttaaatcattaacaaaatgtctctaggtgtttgtcagcaataaacggtatctatatatgtttatttgattttatgtgcatgaagaaaagtatagaagagtatgcattgacttggagggaggtgggtaatgcaggtaggttatgggggagtcaggggtgtagggaaaaggaaaaccaaaaaagaaaaatacataaatgactgaatcacgggtgataccacaaatgtgtgagttagtaaatttggctggggatgggggagctagaattttgctaatttgtggggatgttcatggtatatattgtaaaaagggaaaatttcataataatgtatacgattctatttttaaaaaaagtaaaaactcctgtgtgtgtatatatgcatgtggatgtttatatgaacatagaaaagtgtagaagaatacacacgaaggtgttaacattcattggttaccttggtggagaagggtaataagttttctgaatacctttgcattgtcttgttcacatatattgcttttgtaatttgaaaaacaaaataaagggggaaaacatttcaaactg

SEQ ID NO: 8778 - DNA, 1587 bp, Homo sapiens
aggacgaccaatttcagattcagggcgcggatgcagcataaatgggaaggcacggtttgagaaacggctctttctggcaaaggtaatgacatacgcatctgtgccagcatcccaagagtgaggctggtttctggaaatccattctgactctgtgacagcggggatggatgtgaccttgcccgtggttagaaaacaaatttactgagtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcacacaggagaatcacttgaacccaggaggcagaggttgcagtgagccaagatcgcgccattgcactccaacctgggcaacagagcaaaaagattccatctcaaaagaaaagaaaagaaatctgttaatattattaaaatatttatgtcactttggagaatcttcccttagaagtaaaagctccaatacataaaagacagatgaacatgtgaacatggacatttattgtaaaaattgttcttaatggcaaaaaaacccccaaaaccaaagca

SEQ ID NO: 8779 - DNA, 6712 bp, Homo sapiens
tacaggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcacacaggagagaagccctatgggtgcaatgaatgtgggaaagctttctaccagaagccaaacctcagcagacatcagaaaattcatgctcggaagaatgcctacaggaatgaaaacttaataattgtgggaaatacttgagcaaaatatctggtttcatggtatgtagggaattttttttttttttttttgagttggaatctcactttgtcacccaggctggagtgcagtggcgcgatctcggcttactgcaagctctgcctcccgggttcacgccattctcctgcctcagcctcccgagtagctgggactacaggtgcccaccaccatgcccggctaattttttttttgtatttttagtagagacggggtttcaccgtgttagccaggatggtctcgatctcctgaccttgtgatctgcccgccttgtcctcccaaagtgctgggattacaggcgtgagccaccgcgcctggccggtatgtagggaatttatccttaggagaaatcttatcattttaatgaatttgaacagtgtgtttttattttatttatttatttattttgagttgtattctctgtttcccaggctggagtgcaatggcactatctcggctcactgtaacctcagcctcccaggttcaagcagttctcctgcctcagcctcccaagtagctgggattacaggcacctgccaccacgcctggctaatttttgtatttttagtagagatggggtttcaccatgttggtcaggctggtctctttggctaggctggtctcgaactcctgacctcgtgataccccccaaccccccgcccttggcctcccaaagtgttgggattacaggcatgagccaacgcgcccaaccgacagtgttgtatcataatggaaatcatgatctaattgtgatacaaacttttctagaaaatactttctcaaacataagcatggacaccctggcatgtaaacgtttaaaaatgtattaaatggaataacagcagaatacaaaatatctgtgaagagacttaaaggcatactctggtatattccacagtgagccatacaatcagcattatttgtattttggagttgtaaatgtgaaattaacataaaatgtgaatatcagacacatgtcacacaacatatagaatgccattcagaaaacttttccactttaaatatcatcattgtcttttgatgtcttaacaatacaaaaaaataacaacaacatggcccactattgttaaaagaactttattataccagctacatttttccacctttttgtaatacatgtaaatggctatagaggttgttactgtcctctgcagaaataataaagcagtgtttttaaatgtatttggataatttggccaaaaattttactaaaatgtagttatttatattaaaaatgcaagctaaggaatagtttaagaacctgatactgggtaaatgaaacactgtaaactatttgacaaaatgtagtgtcaccctggtgtacagtacactgttcatattttcttagtcttgcttaaaatatcttgtagcaaattagtagcattgctacactattctagatacactattctatatacaggttgtataactcagaaatgtttcatgcgtagaccactgaaggagaatttcttttctctctatccctctgcaaattaattcaagaatattcatttttttcatataaatttccttgcaagtgtcctagacactaaatcccaaggttttaattatttcaatgtttggaaagaagtctgcttccctgagttgctatgtcatccatattagaaaataaatggccatgtggaatctacatttttcaagatttccctccatgtaagactgcctgatccagaatgagaaaggagacataaccacagatatcaatatgattttttaagtgataaaaagatacctcatacaactctaatcaacatattttttaaaaagaggaggtggatgcttttctaataaacttaagttatgaaaactgcaataagaagtagaaaacttggtaggatagttaacattgaaaaactcaaaaaagctattaaagatctataatgggaaaatgctccaggctcagaagagttcatgcttagttctatcttttaaagaaagagtaataccagtgttatttattatatggatgtaatacaatccatgaactgtactcatttattttattaagtcagaataaattttaacaccaaaatcaaatacagatagttgaaaaaagaaaacttctgctgggtgcggtggctcacgcctgtaatcccaacactttgggaggccgaggcaggtggatcatgaggtcagaagttcgagatggtgaaaccccatctctactaaaaatacaaaaattagccgggtgtggtggcacacacctgtagtcccagctacttgggaggttgaggcatgaggcaggagaattgcttgtacccaggaggtagaggttgcggtgagccaagatcgtgccatccagcctgggtgacaagagcgaaactccgtcaaaaaaaaaaaaaaaaaaagaaaacttcagaccagtcttactcatgaatatagaaacaaaaattatagttaaaatactagcaaatagaattcagccatatacccaaagagtgacatagtaagagtcatcccaagaatgccaaaccagttcagttaataggaaatgcatcaatcaaattaacagtttaaaggagaagaatcatatgaactctcaacagatactgagaaggcatttcatagaatgtgttaatttacattgtaatagatgggaaccacttaaagcggtttttcttaaaaaaaattttttttaacccaaaccccaaagcatatattatgccaaagccattttttaaaatcaggaattcaatattggcttagagattccagtgaaggcaataaaaagaaatgaattggtataaacagcagaaaaggtaaaactatccatttttactgatgatatggttgtacaccaataaatgaaaagactattttttgagttaacttttctaagaagacagggtaccaaaatcaagagctgttctccatactgacaagaaaacataatttatatgtacttcttttggaattacactaaatctcaatgattttttgacaatcattgaaaaaaatatatgaaaaaaatcataccatgtataaaaacatcacatgtacccaataaatatatacaacaattatatatctataataattaaaaatttttaaaatgccatgctagataccagaagataacatgaagccattctaatgaaattaatattgtattggcaaaggaacaggtaaatacatcattagaacacagtagaaaattcagaaatagacttcgatatatatgaactttttcatatgtgaaaaaggtgaaatctgaaaccacaggggaaaagagtagtttacttaaaaagaattctggaacagaaccttttaatcttaaaggaagaaaatttggattaacagcacaaaaataaattctgggtggctttaagacgtaaaattttaaagcaacagaattcttaaaagaaaatcaaaggagcctatgtgtacaatctaggagttgggagatattaactttaccaacacaggacactcagaagctatttagaaataagcagttgaaggctgggtgcagtggctcatgcctgtaatcccaacactttgggaggctgaggcaggaggatcacctgaggttaggagttcaagactagtctggtcaacatggtgaaaccccatctccactaaaaatacaaaaattagctgggtgtggtggcacatgcctgtagtcccagctacttgggaggctgaggcaggagaatcacttgaacctggaaggcaggggttgaagtgagctgagattgcaccactgcactccagcctgggcaacagagcaagactccatctcagaaaaaaagaaaaagaaaaaaaaaaggaaacaaacatttgactacgtagaatcttttggtacaatcttttgggtgacaaaagatgccatcagcaaactcaagagataatagattgtggggaaatatttgtaaagctgatcagagagaaggcattcatgaaatggacaggaaaaaaacccaatagcaaaatgtggcaaagaatatgagttgacagttgtgagaagagcaaatctaagtggccaatggacctgtccaaaaatgtttatcctcagtagtcactgggggatgcagatttaaagttaaaatcaaataacactgtgtaacagcatttttagctatcagaacaaaagatgttacacactgctggtggagaaataaattttgaaaaacaatgcaaattactgttttggaaagaaatctggtaatatttaggctgggcgtggtggctcacacctgtaatcctagcactttgggaggccgaggcaggcaaattgtctgaggtcgggagttcgagaacagcctggccagcatggtgaaaccccgtctctactaaaaatacaaaaattagctgggcatggtggcaggcacctgtgatcccagctactcgggaggctgaggcaggagaatcacttgaacccaggaggcagaggttgcagtgagccaagatcgcgccattgcactccaacctgggcaacagagcaaaaagattccatctcaaaagaaaagaaaagaaatctgttaatattattaaaatatttatgtcactttggagaatcttcccttagaagtaaaagctccaatacataaaagacagatgaacatgtgaacatggacatttattgtaaaaattgttcttaatggcaaaaaaacccccaaaaccaaagcaaacactagaatcaaagtaaatacccatcaactgggaaattgtagaaaggaaaaaactatagtgtatccattccatagaatgttaatatagccattaaggtggacaaattaaaactatgctagtggacttgagtggaattccacaatgttctcttgagtgaaaaatgcaaggtagatattaagtatgttaaatatgactccatttttttaaatcattaacaaaatgtctctaggtgtttgtcagcaataaacggtatctatatatgtttatttgattttatgtgcatgaagaaaagtatagaagagtatgcattgacttggagggaggtgggtaatgcaggtaggttatgggggagtcaggggtgtagggaaaaggaaaaccaaaaaagaaaaatacataaatgactgaatcacgggtgataccacaaatgtgtgagttagtaaatttggctggggatgggggagctagaattttgctaatttgtggggatgttcatggtatatattgtaaaaagggaaaatttcataataatgtatacgattctatttttaaaaaaagtaaaaactcctgtgtgtgtatatatgcatgtggatgtttatatgaacatagaaaagtgtagaagaatacacacgaaggtgttaacattcattggttaccttggtggagaagggtaataagttttctgaatacctttgcattgtcttgttcacatatattgcttttgtaatttgaaaaacaaaataaagggggaaaacatttcaaactgaatg

SEQ ID NO: 8780 - DNA, 1663 bp, Homo sapiens
attcaggatgggacgaccttataccgcggctctttctggcaaaggtaatgacatacgcatctgtgccagcatcccaagagtgaggctggtttctggaaatccattctgactctgtgacagcggggatggatgtgaccttgcccgtggttagaaaacaaatttactgagttctctgggtgccctgcagacctttggatcctgccaccttgctggacgggagggctctctagctcctgccagcccttagagccacaggaccttggtcacaacatctacagaaggccctgcagctaagtgatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcacacaggagagaagccctatgggtgcaatgaatgtgggaaagctttctaccagaagccaaacctcagcagacatcagaaaattcatgctcggaagaatgcctacaggaatgaaaacttaataattgtgggaaatacttga

SEQ ID NO: 8781 - DNA, 4659 bp, Homo sapiens
cccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggcttgttacctggtcatcagttcgagacatctcagcaatgggcactaccggggcattaaaggagtcttcaggggacccctgtgcaagaacggatctccctctccggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcagagactgaaagaattaaagcaacgggaatttgctcgaaatgtagcttctaagtcatggaaagatgagaaaaaacaagaaaaagcacttaaacgacttcatcagctggctgagttaaggcagcaatctgaatgtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaa

SEQ ID NO: 8782 - DNA, 7859 bp, Homo sapiens
ggaagcggctgcggttctcgccggttctcagccggggtttgatagttgtcaggaggattcgacgttcagtgcccagggatgtggagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagatgggaaatttggaattaagccttcccagaggagaatttctgggaaatctacatttcatagtgaaatggagggtgaagacacaagagatgattcattatactctattttagaagaattgtggcaagatgctgaacagataaagagatgtcaggaaaaacacaacaaacttctgagtcgcactactttcctcaataagaaaatattgaatacagagtgggattatgaatataaagactttggaaaatttgttcatccaagcccaaatctcattctttcacagaaaagaccccataaacgtgattcatttgggaagagttttaagcataatttagacttacatattcataataaaagcaatgcagcaaagaacctggataaaactattgggcatggtcaagtttttacccagaactcttcttatagtcaccacgaaaatacacatacaggagtgaagttctgtgaacgtaatcaatgtggaaaagtcctcagcctcaaacactcactcagtcaaaatgtgaaatttcccattggagagaaagcaaacacatgtactgaatttgggaagatcttcacccagaggtcacatttctttgctcctcaaaaaattcatactgtggaaaaacctcatgagcttagcaaatgtgtaaatgtttttacacagaagccactactcagtatatatctgagagttcatagagatgaaaaactctacatatgtactaaatgtgggaaggccttcatccagaattcagaattaattatgcatgagaaaactcatactagagagaaaccctataaatgcaatgaatgtgggaaatcatttttccaggtgtcatctctactcaggcatcagacaactcatactggagaaaaactctttgaatgcagtgaatgtggtaaaggcttctccctgaactcagccctcaatatacatcagaaaattcacactggagagagacatcacaaatgcagtgagtgtgggaaagcctttacccaaaaatcaacactcaggatgcatcagagaattcatacaggagagaggtcctatatctgtactcaatgtgggcaggccttcatccagaaggcacacttgattgcacatcaaagaattcatactggagagaagccttatgaatgcagtgactgtgggaaatctttcccttctaagtcacaactccagatgcataagagaattcatacaggagagaaaccctatatatgcactgaatgtgggaaggctttcaccaacaggtcaaatctcaatactcaccagaagtctcatactggagaaaagtcttatatatgtgctgaatgtgggaaggccttcaccgacaggtcaaatttcaataaacaccagaccattcacactggagagaaaccctatgtttgtgctgattgtgggagggccttcatccagaagtcagagttgattacacatcagagaattcatactacagagaagccttataaatgtcctgactgtgagaaatccttctccaagaaaccacatctcaaagtacatcaacgaattcacacaggggagaaaccatatatatgtgcagaatgtgggaaagccttcactgataggtcaaatttcaataaacatcagacaattcatactggagataaaccgtataaatgcagcgactgtggaaaggggttcacccagaaatcagttctcagtatgcatcgcaatattcatacatgaaagtaatcctgtttcttgaaaatgagagccttataaggctgacaaaagtcaggtctaactatatattataaaattcatccaagacagatcctatatgaatacattgtataaggaaaagcatcaggctatctcacttgagatggaaaaaaattattcagaagaaactctcttaaaaatgcattgaaggagagagaatttgcacagcctcatgaaatatagtaaaagtcatactgggaaaaatgttgtcagtttggtgtgttaggaaaagccttcctatagaaagtattataagttaaattgttaccaaattctttataggaaggagagtgcaaaattatgtaaatgatggtcaggtttactgtgttatattaagcaatttaaagtgataacaaaatgaaaggtagtgcagcaaaataatataactggtgagtagacctactttcagttccatagggtgtttgtggcagaacacagtgcagaacaggaggaatattacattttttttcaaatttagaataattatgtccatcaaatgtttcttactgaatatgtctatcaaatatgtttcttattgaatatttctatcaagtgaatccacaatttaaaagtcactttggttttatatatacacacatctgcagatataattttataagaacacacaaatataatcctgtcattcgtactggtttccatgacatagtatcttgttttctttcattgtggtacaatgcaaagtagccacagattcctcccatcccaagtagcgtctctttgtctactacttgactttgaacttggccacgtgactttctttggccaatggaaattagcaaagagaatcaataagaagcttgagaagtgtgcaaagcctgccttgaagcttaccctctcttgctgctctttgcaaacctgaagaatctcaaattgccctactcgggggtgaggagccaccacatggagcagtggtgagccagccttgctgaggccccttagaccaagtagcctgccaattgtcagaattgggagtgaggttttccaagacctctagccccagctgagccagcctagcccagaagagccataccagttattccagctgatttacagaattgtgagataaataaaatgatgatagttttaagcaacatgagttttggggttagtttgttgtacagaaaatgctaagtaatatttgaaagtatatgtttgggggagggggcatagtggaccaaaacgtgacaagtggcattggctttgggtctgagtggcacgtagaaactggaaaaacagtgaggaaaactgtttttcctcaaataacaaaggttggatagttggcaacccatgttatttagtagggaaagatacagaaaaacagtcatcaccatactctgtgggaagatagagaatggaccaaacgaactggtggatctggctaaggagatttgcagcagaatatgggaagtatcagtttgcttcttttagctgcatatgatacgatacagaaagagagaaatgaactaaagaaataactgtttctttggcaagcagaattcagaagaaatatggaaaagccaaggattgctgggttgaaaaataatgctttcacatcactagtctctccagctatctaactattcgcaaggtaaaaaatggcctcagggtaaagatcaaatcatggttgtgtctgtaagactctttattacagtgtgtgaaatagttcagttggtgcttaggagaccatctcagctaaacttaagggcttctaaaaatcttcatgacgttgtcccatagaagcctgacatactactcaaagtggagagagacctatcttaaaaagaattgctgatgtggcatttggggaaaggagtagatccaaaccagattcataggaaactcacaaagtttttaatagagttttactagtaaaactacctccaggttggacttccagggactgaaacagttcaaaatgaaaagtggcctctggattcccctccctaacttctatgaataggatacaagctgagaaagttactcagatgcaaacacggtccatttcttatggaaaatgaagggcatctcagagggaagacccaagaacaatatattaaaatgagctggggagccgttcccagggagaactgtgccctaatcaagaaacgtatctgcccctggagccaagggaaccgacaacatttgctctgtgggatttcagaatcgttatggaacagtgactgatatgtgcctcatggtcctcctctttttgaatgggagtgtctattacagttatcctgtacctatcccaccattgtatatattgggtgtatgttggggggcatgtaacttgtcatttagctcacaggtatctggatcaagaaactgaaaaactgtacccaaggaacctcagccacacctgaacctgatacagaagacttgagattctggattggagcttgatgccacaattttggatgagaaatttggaggtcctggaataggggtgaacacattttgcatggggtggtaatgtgaatactttgtgaccagaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttcttgcattttcccatgtctacagctagagaactctttgggatcccttttataagggcaccaatcccattcatgagttctccacccacattacctaactaccacccaaaggctccacctcctaataccatcacattgaggattaggattttaacatatgaattttgggggggatgcaatcattcagcccataataccctctaacatattaatcatagttatttttaactccctgtctgatagttccaactactaggtcaactgagtctaggtctgttgttgtcttctcttgctcttttgcatctaataatttttggctgaatgtcacagatgttgtatgtaggacagtagaaactgaggtaaatagtaattattcctggaaacagccatggttgcccttttgataggccattagcatggggagattgaatccatctaatcaggagttgggctgagtttgtgtttctttgttgccagtgttacctttgctgtaccatagacttaaaattcctctattgttatcttatgcttgaggtaggcactggtttgcccagagaatttttatttttcccagaccacacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctttaatgatctgggcccaggatgatttcctgcccttttatcatgggtggaatttttttttccatttccctcactctagtcacagtgaatctttaactgtgtcctgagggcaacagggtttgctgcacttcttttagtggcttaaggattttgttctgtaggggagtagggtttcattggagctttgtgccatttctatgttaacagcagcccccttgcaggcctaccccatggaggtaggctttctccagtcttcttccttgtccccgtgtttcttgagagcactcagtggatgactatggagaagagcctgcaagcagagaccaactacccttaggtctacagctctcatgagtctcccgcactcagcctttagcaattcattaaaaattcttgttgaattcttactgcttgtatagtggcctcatcttccttcctgctgtaccacagatggcccaggagaggcacttgtcttttattatatttcaagctagttggttgctctgtaatcttagctctctgatgggttcgagaaaacttatgtttttgcagattacccagctttgttcttgttataaagatgggagcagtgttctttccagatgtctacatgctaggcagaaactagaagtctggacagtctccatggtctcctactatcagaatatgtgcccttttcagtgtgactttgccacttcacccatcaagaggtagaatctatttcttcaacccctgcaactgagcttggctattttgttggccaatgggacattaacaagtatgatacaagcagaggcttgagaagtgcctgcacaatgaggcttgcccacttttgcagctctttggaatcctgaacccatgtgtggaaaagcctgaactgtgctgttggaaaatgagagcgatcacatggagcagtaatggagcaaagaccagccatcccagttgagataccctacaccaaccagattttcaactgctggacatatgaatgaagctatcctaggcatgcagtcttggtcaaggcaactttggctggcagtctctgagatgaccctgaatgatccccacctcctggtattctcactcttatataatcccctcctcttgagtttggactggaattagtgacttggttctagtgaatagaatgaggcagaggtaatgggatgtcatgttcaagattggttacaaaaagactgtggcttccattttgggtgcttgcttactctctcagatggctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaacactttcatgttttaatctctgctctgtgctcataatcatatatagacat

SEQ ID NO: 8783 - DNA, 2098 bp, Homo sapiens
gtcaaatacagaatgtgatgttccattccagccaatggaaaccggacgctgcagtagggtggacacgtcaggttataaatgaccctgtttcctttgtttagtgtactctagtggcaaaactgctggctagtgtacctgttctgccaaaagtaaaatgggcttactgaggaaattaaatttatgttcaagtgctatttctttatgcaccggggaacaagcatttctaacaacctggtcctacgtggctgaaactggatcccagaagccccgtccttcccgaagctcgtagcggaagtgacatcagcccgccgccactatcttttcccgcgctggctgcccacggtcagtgctgtttcacctttatcttggtggagtcgaccccggctgtggacttcaaataaccctgtacaaagaggaatggagattgcctctattcacctagattcataagttgccctgaggcaatcttggcatcaaggaagagagcattgaggcacaactgaccatcagcttcagagaatggcagtcactgatttgtcccatgggttttttcccagggaaccaatctgcccttttgaagaaaagacaaagataggaacgatggtggaggactacctggcaaattcttatcaggattcagtgacgtttgatgatgtggctgtggagttcaccccagaggagtgggctttactggacacaactgagaaatgcctctacagagatgtgatgttggagaactatgtgaacctggcctctgtggaagctacagtggatggaaactctgagaattgtggagaggtcttcagtgaatggttttgccttaaaacacacatgagagctcagaatggagggaacatctttgagggtaattgttatggaaaagacatcctcagtgtgcacaaggaagcctctattggacaggaactttccaaatttaatccatgtggaaaagtcttcaccttaactccagatcttgctgcacatcttggaattctcaatgcaagacaaccatacaaatgtaaggaatgtagaaaaggctttaagtattttgcaagccttgataatcacatgggaatccacattggagagaaattctgtgaatttcaggaatgtaggagagccatcactcattcctcacacctaaagcagtgtgtaacagttcatactggaaagaaatctaaaaagactaagaaacatgggaaatccttcactaatttttctcaactttctgcacatgtgaaaattcataaaggagagaagtcctttgaatgtaaagaatgtggaagatcctttagaaattcctcatcctttaatgttcacattcaaattcacactggaataaaaccacacaaatatacggaatgtgggaaagccttcactaggtcaactcaccttactcaacatgtaagaactcacactggaataaaaccctatgaatgtaaggaatgtggccaagccttcactcagtacacgggccttgctatacacatacgaaatcacactggagagaaacactatcagtgtaaggaatgtgggaaagccttcaatggatcctcaacccttactcaacataaaataattcacacaggagagaagccttatggatgtgttgaatgtgggaagaccttcattacttcttcctatcgtagtaaacatttgaaaactcaccatgaagaaaggccctttgtatgcaagatatgtgggaaagcatttctatattcctcaccccttaatgttcacctgcaaactcataccagagagaaagccctcatatgtaaagaatgtgggaaagcttttgctgtttcctcacacctaagtagacatgaaagaattcacactggggaggaaccctatgaatataagggtatgaatgttaccatttagctcattggttgccatctttaattagtggcagtgacactaaagatattcagatttgtcctaaatgccttttggaggttgtaatggctcatgaattggccttgggtgccatcacaagggtctgaaattaaacctacaggttctgaatacaacatcatggttgcctgagtctgggcatctgtgaagaagggtaatggatggtgaggtcagtactgca

SEQ ID NO: 8784 - DNA, 2006 bp, Homo sapiens
aatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcaaagaggtgtaagttgcatgtgtcaggggagtcatctgtcttcagtgagagtgggaaggactttttgcccaggtcaggattactccagcaggaggccagtcacactggggagaagtcaaacagcaaaactgagtgtgtgtctcccattcagtgtgggggagctcactacagctgtggagaatccatgaaacattttagcaccaaacatatactcagtcagcaccagagactgctcactagagaagagtgttatgtgtgctgtgaatgtgggaagtcctttagcaaatatgctagcttcagtaatcatcagagagttcacactgacaaaaaacattatgaatgtggagaatgtgggaaatcctttagtcaaaagagcagcctcattcaacatcagcgatttcacactggagaaaaaccttatgggtgtgaagaatgtgggaaatcttttagtcataagcgcagccttgttcaccatcagcgagttcacagtggagaaagaccttatcagtgtggagaatgtgggaaatctttcagtcaaaagggcaacctcgttctacaccagcgagttcacactggagcaagaccttatgagtgtggagaatgtgggaaatcatttagtcataagcgcagccttgttcaccatcagcgcatgcacactggagaaagaccttacaagtgtggagactgtgggaaatcttttaatgaaaaaggacaccttaggaatcatcagcgagttcacactacagaaagaccttttaagtgtggggaatgtgggaaatgttttagtcacaagggtaacctcattctacaccagcatggccatactggagaaagaccttatgtatgtagggaatgtggaaaattatttaagaagaagtctcacctccttgtacaccagagaattcacaatggagaaaagccatatgcttgtgaagcttgtcagaaattttttagaaacaactctacattctgtgttcataagcgaattcacactggagaaaagccttatgagtgcagtgaatgtggaaaatctttcgctgaaagctccagtttcacaaaacacaaaagagttcacactggagaaaagccttatgagtgcagtgaatgtggaaaatcttttgctgaaagctccagtctcactaaacacaagagagttcacactggagaaaagccttataaatgtgagaaatgtgggaaattatttaacaagaagtctcacctccttgtacaccagagttcacactggagaaaagccatatga

SEQ ID NO: 8785 - DNA, 6283 bp, Homo sapiens
aatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcaaagaggtgtaagttgcatgtgtcaggggagtcatctgtcttcagtgagagtgggaaggactttttgcccaggtcaggattactccagcaggaggccagtcacactggggagaagtcaaacagcaaaactgagtgtgtgtctcccattcagtgtgggggagctcactacagctgtggagaatccatgaaacattttagcaccaaacatatactcagtcagcaccagagactgctcactagagaagagtgttatgtgtgctgtgaatgtgggaagtcctttagcaaatatgctagcttgagtaatcatcagagagttcacactgaaaaaaaacatgaatgtggagaatgtgggaaatcctttagcaaatatgttagcttcagtaatcatcagagagttcacactgaaaaaaaacatgaatgtggagaatgtgggaaatcctttagcaaatatgttagcttcagtaatcatcagagagttcacactgggaaaagaccttatgaatgtggagaatgtgggaaatcgtttagcaaatatgctagcttcagtaatcatcagagagttcacactgaaaaaaaacattatgaatgtggagaatgtgggaaatcctttagcaaatatgttagcttcagtaatcatcagagagttcacactgggaaaagaccttatgaatgtggagaatgtgggaaatcgtttagcaaatatgctagcttcagtaatcatcagagagttcacactgacaaaaaacattatgaatgtggagaatgtgggaaatcctttagtcaaaagagcagcctcattcaacatcagcgatttcacactggagaaaaaccttatgggtgtgaagaatgtgggaaatcttttagttcagaaggacatcttaggagccatcaacgagttcacgccggagaaagacctttcaagtgtggagaatgtgtgaaatctttcagtcataagcgcagccttgttcaccatcagcgagttcacagtggagaaagaccttatcagtgtggagaatgtgggaaatctttcagtcaaaagggcaacctcgttctacaccagcgagttcacactggagcaagaccttatgagtgtggagaatgtgggaaatcatttagttcaaaaggacatcttaggaaccatcagcaaattcacactggggacagactttatgagtgtggagagtgtgggaaatcttttagtcataaaggcaccctcattctacatcagcgagttcaccctagagaaagatcttatgggtgtggagaatgtgggaaatcttttagttcaatcgggcaccttaggagccatcagcgcgttcatactggagagaggccttatgagtgtggagaatgtgggaaatcttttagtcataagcgcagccttgttcaccatcagcgcatgcacactggagaaagaccttacaagtgtggagactgtgggaaatcttttaatgaaaaaggacaccttaggaatcatcagcgagttcacactacagaaagaccttttaagtgtggggaatgtgggaaatgttttagtcacaagggtaacctcattctacaccagcatggccatactggagaaagaccttatgtatgtagggaatgtggaaaattatttaagaagaagtctcacctccttgtacaccagagaattcacaatggagaaaagccatatgcttgtgaagcttgtcagaaattttttagaaacaagtaccaactcattgcacatcagagagttcacactggagaaaggccttatgaatgcaatgattgtggaaaatcatttacccacagctctacattctgtgttcataagcgaattcacactggagaaaagccttatgagtgcagtgaatgtggaaaatctttcgctgaaagctccagtttcacaaaacacaaaagagttcacactggagaaaagccttatgagtgcagtgaatgtggaaaatcttttgctgaaagctccagtctcactaaacacaagagagttcacactggagaaaagccttataaatgtgagaaatgtgggaaattatttaacaagaagtctcacctccttgtacaccagagttcacactggagaaaagccatatgagtgtgaggattgtcagaaagtttttagcaagaaggaccacctcattgcacaccagagagttcacactggagaaaggccatatgaatgcagtgattgtgggaagtcatctacccacagctctgcattctgtgttcataagagagttcacactggtcacaccaccttatgagtgcagtgaatgtgggaaatcctttgctgaaactttcagtctcattaaacacaggagagttcacactggagtaaggtcttgtgattgcagcaaatgtgggaaaaaagttacctgaaggtcttttctccttgaatatcagagagttcacactagacaaataaaatacatttgggcaattttgtagccacacctctttgctccttcaagatcagagttaacactggatcagggccttaccagtgtgacatgtgagatatttatgtagaaatctagcttcataacacacaggagacttcccactgcagaaatgccttttgaatgtaatgaatgcaagaaagccttcagcctttttattggagcctcaaacattgacatgagaaaaacaccatagatgtatatggaatgttatttctttttcaatgtaaccctttgagagtgccacctacctagattgaatgtcatttattgagcatctgcaaaagttccaagtgtgtggcagctacagtgcatttttcactatacccaggtaccttgctagattttttttgagacaggttgtcactgtgtcgctcaggatggcgtgcagtggtgtgttcacatttcactgcacccttgatctgggcttaagtgattctgttgcctcggcctcctgagtagctgaaaccacaggcatgcactaccatgctccactaatttttttaagttttggagagacagggtctcaccatgttgcccaggctggtcttaaactcctggctcaagcgatccttccaccttggcctccaaacatgctgggattacaggtgtgagttactgtgcctggccttttttttttttttttttaacttttaatttctgatcgagtcacagaaggatttgttgagtagcttcagcacttcttcctttgtcatttttttctgtctgataagtcatgccatggacgttacccatttttatcccagaggcctcttacgttgacttgaaaagacggactatgtctttcagagatcttgtgggtatcacatcaatcttgacaaattttctaccctccaagtcatgatcctaagaacagcttgcctcccatttctccggtttgtgctattatgaaggccttattgtttcagccttcttcaatcttgagggttgttgtcactgtatgggtggttcagaaataagtaggtcctgttactatgaagggggtcacagcttttgttggcatagctaaactttgtggctcatggaacagtatgaatgcagaatgtagctttctccacttgtggactgctttgcatagctgccagaggcctccagagaagaccttcagggctttgtggtctttatctgtagcacggatactaaaatttgtgggttcataggtcagctggatacagggcattttttgtgacaatttctggcattttttgaacaagacaaaattcttttacgaggtatattgcattgtacttggtacggctgagggaagtctgttgcccagctcttgcaatgcagacacatgccctgatatccagaattctgtaggataacatcacagattgtaatgctatcaggtgaaattataattttatagaattactttatttataggcagtggaggagacagaataatgtaactgcaactcatgtcttttttttctttttttttctttttttttgaggcagagcctcaccctgttgcccaggctggagtgcagtggcataatcttggctcacggcaacctctgcctcccaggttcaaacgattctcctgcctcagcctcctgagtagctgggactacaggcacatgccaccacacccagctaatttttgtatttttagtagagatggggtttcaccatgttggccaggctggtctcgaactcctgaccttgtgatctgctggcctcagcctcccaaagtcctgggattacaggtgagccaccacgtgcagcgtaatgcatgtcttttaaaagggcatccacaatgatccagtcactacgtatatgatgaatatgcagatacaggaattatcaggacttccataatgatgaatattgtattgttgaggccattgtcagaggaaataatctaaaggttttgtgaattcctgtactcattctgggctgttctcctcaaggtcattcctgcattaacaggaggaagatgatagggagaagggagatctcagttcagtgatgtggcctttgtgaccagccagccacttaatcaggtggaaatggccttagtgccacatcaatatttgctaccgtggaggctagttttcccacttagggcatgagaagaattggtgtagtcagtatagagttgccaaacctgttttccaaaaataatggtaaatctatatttttcttttgaactgcatttttttaattattattattatttattttgagacggagtcttgctctgttgcccaggctggatggagtgcagtggcacgatctcggctcactgcaagctctgcctcctgggttcacaccattcttctgcctcagcctcccaagtagctgggactacaggtgcccgccaccatacccagctaattttttgtatctttactagagatggggtttcaccatgttaactaggatggtctcgatctcctgacctcgtgatccgcctgccttggcctcccaaagtgctgggattataggcatgagccaccgtgcccaaccttttttttttttttttgagacagagtctcactgtcagccaggctggagtgcagtggcatgaccttggctcattgcaacctctacctcctaggttcaagcaattctcctggctcagcctcccatgtaggtgggactggaagcatgtgccaccatgcccggccaagttttgtatttttagtagagacggagttttgccatgttggccaggctgatcttggactcctgacctcaggtgatatgcctgcctcagcctcccagagtggtgggaatacaggtgtgagccactgctgccagtctgaagtatattttaaagctgtgatgagttataaatgacattcagtaagctatgcatatttaagctgtagcatgtgataaatcttgagtttcatataatcccatgaaaccattaacatagtcacaataatgaacttaacacctttatatttacttggaacctttttataaaggctttctttctgttctccagacaaccaatgatttactttgctgtacagtagagtactttccattttctggaatgttagatgagtgatgtaataaagtgtttcctcttataatc

SEQ ID NO: 8786 - DNA, 1825 bp, Homo sapiens
catctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatcttt

SEQ ID NO: 8787 - DNA, 1951 bp, Homo sapiens
catctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatcttt

SEQ ID NO: 8788 - DNA, 1821 bp, Homo sapiens
ctaaatttagatttcggagattgtgttgtctaagggtttgtctgagccgcctcggaagacctccggctcttgtcaggctcttgtctggtaattcctgggaatttacctgggctcatgcttgaagaagcagagggaccatctcggctgattagacacgccccagacccaaccccaggggtcaggtgaacagccaggcggctaagtgaccagctttcttgtcctctcctttttggcagatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatcttt

SEQ ID NO: 8789 - DNA, 1748 bp, Homo sapiens
gcacgcgcctcactagctgcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggcaaggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccc

SEQ ID NO: 8790 - DNA, 1858 bp, Homo sapiens
agtccccgcgtctgggtctcgcagaaaagcttctaaatttagatttcggagattgtgttgtctaagggtttgtctgagccgcctcggaagacctccggctcttgtcaggctcttgtctggtaattcctgggaatttacctgggctcatgcttgaagaagcagagggaccatctcggctgattagacacgccccagacccaaccccaggggtcaggtgaacagccaggcggctaagtgaccagctttcttgtcctctcctttttggcagatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaa

SEQ ID NO: 8791 - DNA, 1998 bp, Homo sapiens
gtccctggcagccagtgtgacccagagaaaagatgtgagatcaagacagcagcccagggatcgaggatggagggactcttgagcgtcgccctccagggcgcagagttggaaggaaactggaaacacgagggccaggttgaggacctgcaggaaaaccaggaaagctgtccagagccagaggccgtggcctgcaagggagaccctgctggggacagcatgcaggaacgcgatgaattcagccgaatcccaagaaccatatcgagccctgctgctacccaagccagtgtccccgacgacagcagttcccggaggtgcagcgcgcctggggagagcccgaaggagaggcatcctgacagccgccagcgggagagaggtggaggccccaagaagccgtggaaatgcggggactgcgggaaggccttcagctactgttcagcgttcatcttacaccagagaatccacaccggggagaagccatttgcgtgccccgagtgcggcaaggccttcagccagagcgtgcacctgaccctgcaccagcgcacgcacacgggcgagaagccctacgcctgccacgagtgcggcaaggccttcagccagggctcgtacctggcgtcccactggcgcacgcacacgggcgagaagccgcaccgctgcgccgactgcggcaaggccttcacgcgcgtcacgcacctgacccagcaccggcgcgtgcacacgggcgagcggccctacgcgtgcgcccagtgcgccaaggcgttccgcaaccgctcgtccctgatagagcaccagcgcatccacaccggtgagaagccctacgagtgctccgcgtgcgccaaggccttccgcttctcctcagcgctcatccgccaccagcgcatccacacggaggagaagccctaccgctgcggccagtgcgccaaggccttcgcgcagatcgcgcacctgacccagcaccggcgcgtgcacacgggcgagaagccctacacgtgccaggactgcggcgcgctcttcagccagagcgcctctctggccgagcaccggcgcatccacacaggcgagaagccctacgcgtgcggccagtgcgccaaggccttcacccaggtgtcgcacctgacgcagcaccagcgcacgcacaccggagagcggccttacccctgccacgactgcggcaagcgcttcagcaaccgctcccacctcctccagcaccgcctcgtgcacaccggtgagcggccctacaggtgcctgcaatgcggggccgccttcagccacgtgtcctcgcttatagagcaccagaagatccacaccggagagcggccctacaagtgcggcgagtgcggcaaagctttcagccagggctcctcgctcgccctgcaccagcgcacgcacacgggcgagcggccctacacctgccccgagtgcggcaaggccttcagcaaccgctcctacctgatccagcaccacatcgtgcacaccggggagaagccctacgagtgcagcggctgcgggaaggccttcagcttctcctccgcgctcatccgacaccagaggacgcatgcagacagttcgggacgcctttgcccagctcccacgcctgactcaacacctgggctctcacagggaggagaaacctgtcaacaggggtgccctggcagaaacccgcgtggaccagcagaagattaagagctgagggcctcctttccaacctcacaatgctatgggggagatactgtgttatccccgacgcttcctgtgaggaaaccgaggctcagagaagcttgttaacttgcctgagggcacacagtggggaagacacagggctaagactgtacctcacatctgccagactcccctgcggtcttcctggtgcaaaattataaatggggcacgggcaagtagacctgcagaaacacctatggctggcctttaatttctttctttttttctttgagacagtgtctctctctgtcacccaggctagagtgcagtggagcgatctcg

SEQ ID NO: 8792 - DNA, 2159 bp, Homo sapiens
ggtgcgcgggctcctccgcagcagcagaagtcttgaccttagctcgtctaaggaaggaggcaccagggtctgcgttggcccaggaggacccgagactgagtagaagcggagccgactgcaccaggctaggagggggccggccagcgcgttcgaaggtgataccgggaggcgagagcaacgacccagagaaaagatgtgagatcaagacagcagcccagggatcgaggatggagggactcttgagcgtcgccctccagggcgcagagttggaaggaaactggaaacacgagggccaggttgaggacctgcaggaaaaccaggaaagctgtccagagccagaggccgtggcctgcaagggagaccctgctggggacagcatgcaggaacgcgatgaattcagccgaatcccaagaaccatatcgagccctgctgctacccaagccagtgtccccgacgacagcagttcccggaggtgcagcgcgcctggggagagcccgaaggagaggcatcctgacagccgccagcgggagagaggtggaggccccaagaagccgtggaaatgcggggactgcgggaaggccttcagctactgttcagcgttcatcttacaccagagaatccacaccggggagaagccatttgcgtgccccgagtgcggcaaggccttcagccagagcgtgcacctgaccctgcaccagcgcacgcacacgggcgagaagccctacgcctgccacgagtgcggcaaggccttcagccagggctcgtacctggcgtcccactggcgcacgcacacgggcgagaagccgcaccgctgcgccgactgcggcaaggccttcacgcgcgtcacgcacctgacccagcaccggcgcgtgcacacgggcgagcggccctacgcgtgcgcccagtgcgccaaggcgttccgcaaccgctcgtccctgatagagcaccagcgcatccacaccggtgagaagccctacgagtgctccgcgtgcgccaaggccttccgcttctcctcagcgctcatccgccaccagcgcatccacacggaggagaagccctaccgctgcggccagtgcgccaaggccttcgcgcagatcgcgcacctgacccagcaccggcgcgtgcacacgggcgagaagccctacacgtgccaggactgcggcgcgctcttcagccagagcgcctctctggccgagcaccggcgcatccacacaggcgagaagccctacgcgtgcggccagtgcgccaaggccttcacccaggtgtcgcacctgacgcagcaccagcgcacgcacaccggagagcggccttacccctgccacgactgcggcaagcgcttcagcaaccgctcccacctcctccagcaccgcctcgtgcacaccggtgagcggccctacaggtgcctgcaatgcggggccgccttcagccacgtgtcctcgcttatagagcaccagaagatccacaccggagagcggccctacaagtgcggcgagtgcggcaaagctttcagccagggctcctcgctcgccctgcaccagcgcacgcacacgggcgagcggccctacacctgccccgagtgcggcaaggccttcagcaaccgctcctacctgatccagcaccacatcgtgcacaccggggagaagccctacgagtgcagcggctgcgggaaggccttcagcttctcctccgcgctcatccgacaccagaggacgcatgcagacagttcgggacgcctttgcccagctcccacgcctgactcaacacctgggctctcacagggaggagaaacctgtcaacaggggtgccctggcagaaacccgcgtggaccagcagaagattaagagctgagggcctcctttccaacctcacaatgctatgggggagatactgtgttatccccgacgcttcctgtgaggaaaccgaggctcagagaagcttgttaacttgcctgagggcacacagtggggaagacacagggctaagactgtacctcacatctgccagactcccctgcggtcttcctggtgcaaaattataaatggggcacgggcaagtagacctgcagaaacacctatggctggcctttaatttctttctttttttctttgagacagtgtctctctctgtcacccaggctagagtgcagtggagcgatctcg

SEQ ID NO: 8793 - DNA, 3325 bp, Homo sapiens
ggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtgagggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatt

SEQ ID NO: 8794 - DNA, 3090 bp, Homo sapiens
ggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatgttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatt

SEQ ID NO: 8795 - DNA, 2987 bp, Homo sapiens
cccgcctcggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 8796 - DNA, 2971 bp, Homo sapiens
agaatgccattggttaggccttttacttttgtcgttttaaaggacactctggacatccaaccgatgcacatcccacgcccccaccccccacgtttcctgaggctgcgtctggcctggaggaaccgcccagtgaagacaggtgctcgcagatatcaccgcctagtgttccctgggcccacttgcggggaagtcttggaggtgaaaatccaggtctggaatgaatgcattccacagatgcatatggagagctactgcatgcccagcaccattcctaggctgggagcaaaacgcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttc

SEQ ID NO: 8797 - DNA, 2905 bp, Homo sapiens
gaaacactctcgttaacaattcaaactgtggtcccctcccagatgtataaatccaaatgtttaggggtgggcacagtactctgcatctccagacagcatcctccgctgattcggatgcatgatgacgtcagaacacttggatattgtggtaacttttgggccaggggctctgaaaccccgaagacctccccctgggagatccgggacagctcccagagaagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 8798 - DNA, 1047 bp, Homo sapiens
atgagaagcctcccctttgccctgactgtggaaagcgtttcagccagagctcctacctgctgcagcaccggcagattcacccagggccgtcagccctgcaagtgcaaggcctgcgggaggggttttactcagagcgcatccctcctccagcactggcgggtccacagcgactggcgagagaccttgtcgctgtccccagtgcggcaagacctgctgtggccgctccaacctcatcaagcaccagcgagtccactcgggagaagccattcgtctgcgggagtgcggcaagggtttagcggccagctctgctgctggctcaccaaggagcacacactggccgaagccctgcgtctgtccccagtaccagcaggtttttggggaccggtggaagctgatcggccaccagcgaattcacacaggagagtgtgtcccttctgctgctgcagctgcggtgacagtgtcaatgagaagacctccctctcccagcgcgtccttccgcacccaggggagaagacctgcaggggtgggagcgtggagagcgtcagcctcgcacccagctcagtcgccccggacagcacctctgggctccggccctgtgggagccccgggtccttccttcaacatctgcccccatccacactcctgccccgacctcccttcctttatcctggccccccactcagtctccagcctctggttccatccggccttcccgcagtgcctgcagtgcctctgggaggcctggaagttgcccaggttccgccagccacccagccggcagctcagcaggagggggcgatggggcccagaagctgtgcgagcgcgggacgggactcgcgggaggcggttcaggccccaggctaccctgagccagcccggaaggcctcgcagcacagagcggccggaccgctcggcgaggccagggccaggcttcagcgacagtgccgagctcctccaccgccctcgaacccacactggagaggagccctaccagtgtttccggtgtggaaggcctccagccggaggtccaacctggcccgacactga

SEQ ID NO: 8799 - DNA, 2296 bp, Homo sapiens
gttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaa

SEQ ID NO: 8800 - DNA, 7714 bp, Homo sapiens
gtttgctgtgccgatttagctgccgccgcgccttggagtcctgaggaacttggctaggctggccccgagcggaaccagagaatgctgaggctctaaccatggaatattcggaatgtcccattctatgaaggaggtttgctggctgcaacaggaatattcatgaacatggaggggttggtcatgttccaggatctgtctatagacttctctcaggaggaatgggagtgcctggacgctgctcagaaggacttatacagagatgtaatgatggagaactacagcagcctggtctcactaggtctctctatcccaaagcctgatgtgatttccttactggagcaagggaaagagccctggatggtttcaagggacgtgctgggaggatggtgccgagactcggagtttagatgtaagaccaaagattcatgtttgccaaaagaaatctatgaagtaacatcatctcagtgggtgagaatggaaaaatgtcatagccttgtgggctccagtgtcagagatgactgggaatgcaaaggccagtttcagcaccaagatataaatcaggagcgatatttggaaaaagcaataatgacttatgaaacaacaccaactttctgcctacagacatctctcactctgcatcatcggattcatcctggagagaaactgtataaatccacagaatgtatggcttttaagtatggctcagaacttacacaacagcaagaaacccatactggtgaaaaactctataaatgtaaggagtgtgggaaggcctttcatcacttttcctatcttgttaaacatcagagaattcatactggggaaaagccctgtgcatgtaaagaatatggaaaagcttttatttctggctcacatcttattcaacaccagaaaatgtatacagatgagagacctcatgagtgtcaggaatccgtgaaggcctttagaccgtctgcacatcttattcaacattggagaattcatactggtgacaaaccttatgaatgtaaagaatgtgggaaatcttttacttctggctcaacactaaatcaacatcagcaaattcacactggtgagaaaccctatcattgtaagcaatgtggaaaatcttttactgttggctcaacactaattcgacaccagcaaattcacactggtgagaaaccgtatgattgtaaggaatgtggaaaatcttttgcttcaggctcagcactaattcgacatcagcgaattcacactggtgagaaaccctatgactgtaaggaatgtggaaaatcttttacttttcactcagctctaattcgacatcagcgaattcacactggtgagaaaccctatgattgtaaggaatgtgggaaatcttttacttttcgctcagggttaattggacaccaggcaattcacactggtgagaaaccctatgattgtaaagaatgtggaaaatcttttactgctggctcaacactaattcaacatcagcgaattcacactggtgagaaaccctatgattgtaaggagtgtgggaaatcttttgcttcgggctcagcactacttcaacatcagcggattcacactggtgagaaaccctattgttgtaaggaatgtggaaaatcttttacttttcgctcaacacgcaatcgacaccagcgaatccacactggtgagaaaccctataattgtaaagaatgtggaaaatcttttgcttctggctcagcactacttcaacatcagcgaattcacactggtgagaaaccctatcattgtaaggaatgtggaaaatcttttacttttcgctcagggctaattggacatcaggcagttcacactggtgagaaaccctatgattgtaaagaatgtggaaaatcttttacttctcgctcagcactaattcaacatcagcgaattcacactggtgagaaaccctatcactgtaaggaatgtggaaaatcttttactgttggctcaacactacttcaacatcagcaaattcacactggtgagaaaccttatgattgtaaggaatgtgggaaggcctttagacttcgtttacgacttactcaacatcaacaaatccatactggtgagaaaccttatcaatgtcaggaatgtgggaaagcctttgtcagtgtctcaggactcacccaacatcacagaattcacactggtgagaaaccctatgaatgtccggactgtgggaaggcctttagacagcgtacataccttaatcaacatcggagaattcatactggtgagaaaccttatgaatgtaaagaatgtgggaaatcttttactttctgctcaggactaattcaacatcagcaaaatcacactgatgagaaaccctatgatggtaaggaatgtgggaaatcttttacttctcactcaacactaattcaacatcagcaaattcacactggtgagaaaccctatgattgtaaggaatgtgggaaatcttttacttctcactcaacactaattcaacatcagcaaatacacactggtgagaagctctatgattgtaaggaatgtgggaaatcttttacttctcattcaacactaattcaacatcagccacttcacactggtgagaaaccttatcattgcaaggaatgtgggaaatcttttactcttcgctcagcactaattcaacatcggccagttcacactggtgagaaacgctacagttgtaaagaatgtgggaaatcttttacttctcgctcaacactaattgaacatcagcgaattcacactggtgagaaaccctatcattgtaaggaatgtggaaaatcttttgcttttcgctcagcaataatccaacatcggcgaattcacactggtgagaaaccctatgattgtaaggaatgtggcaaggcctttagacgtcgttcaaaacttactcaacatcaacgaatccatactggtgagaaaccttatcgatgtcatgaatgtggaaaagcctttgtccgtttctcaggactcaccaaacatcacagtattcacactggcgagaaaccctatgaatgtaagacatgtgggaagtccttcagacagcgtacacaccttactctacatcagagaattcataccggtgacagaccttatgaatgtaaagaatgtgggaaatcttttacttgcggctcagaactaattcgacatcagcgaactcacactggtgagaaaccttatgattgtaaggaatgtgggaaggcctttagatgtccttcacaacttagtcaacataaacgaatccatactggtgagaaaacttatcaatgtccggaatgtgggaaagcctttttctatgcctcaggactcagccgacatcagagtgttcacactggcgagaaaccctatgaatgtaagacatgtgggaaggcctttaaacagcttacacagcttactcgacatcagagaattcatgacctaacataattaatgtaggaaactgttctcatgccatttgtcatggatcatcagcagattccatatgtgggtcaaatacaatggatgtgtattacttcatattcactttttccagaattacgacttttttttttttttttgagacggagtcttgctctgtcgcccaggctggagtgcagtggcgctatctcggctcactgcaagctctgcctcctgggttcatgccattctcctgcctcagcctccctagtagctgggactacaggtacctgccaccacgcctggctaatttttttgtttttgtatttttagtagagacagggtttcactgtgttagccaggatggtctcgatctcctgacctggtgatccacccaccaaaattaggacatttaatactgaaagaaattgataatgaatgtagatgagttttctatcatgattcaaagcttattgaagttatacaaattcatattagagaatgtggtcaatgacaaaagacaaccatttactacctacgtgacattaggctagttatgtaaattctctgtgccaaaattactaattgataaaatgttgatggcaatagttgtttttgtgtattttttgtttgtttgttttgttttgagacagagtcttgctctgttgcccaggctggagtgcagtggtgctatcttggctcactgcaacctctgcctcctgggttcaagtgattctcctgcctctgcctcctgagtagctcagattacaggcatgcaccaccatgcttggctaatttttgtatttttagtagagacggggtttcactgtgttggtcagggtggtctcaaacttttgacctcgtgatccccctacctcggcctcccaaagtgctgggattacaggtgtgagccaccacgcctggctagtaatagtttttttataataaataagtgtgactatatttttcatgtttgactactgactttgttttaagcttcgccttccctgtctatttccctgtctactttagcccataactgcaaaggtggctaagaaagtccttgctggaaagaaagcaagcaaaactaaagtctgtgcgcaccttctcctttggatccagtgggcaatttatattagaaattccaagccgggcgtggtggctcacgcctgtaatgccagcactttcggaggctgaggtgggtggatcacctgaggttaagagttcaagaccagcctggccaacatgttgaaaccccatctctactaaaaatacaaaatcagccagacatggtggcatatgcctgtaatcccagctattcaggaggcaaggctggagaatcgcttgaacctgggaggcggatgttgcagtgagccagtcagtggagcagtcagaacacacacagtgtttatcaattaagtttgtagtcagaacacacaccatgtttatcaattaagtttgctgtcttatatggacacagtttgtgatgccctaaaacaagtagtggtgcctaagataatcataggccaccataacagatataacaacaatgagaaagttgaaatattgttgggatcatccaaatatgacacagatacaaagtgagcacatgctggtgaataaatggagccaatagacttgttcactgcatggttacgtcagaggcgtgtaaaccagagcaacttcttcttgaataggagctgtgtaaagtaacactgaaacctactggactgcattcctagacagataagtcattctaagtcacaagatgagatatgaggtcagcataagatacaggtcataaagaccttgctgagaaaacatcttgcagtaaagaagtcggccaaatccaagatggtgacaagagtgacctctggtcgtcctcactgctatactcccagcagcaccatgacacccagctaagtttttattttttatttcagtagagttggagtcttgctttgttacccaggctggtcttgaattcctgtcttcaagcaatcttcccaccttatgaatataaagaatggcccaccttgtcctctcaaagtgctgggattacaatcatgagccactgcacctgggactttctttttcttttttcttttttttttttttgagatggagttttgctcttgttgcccaggctggagtgcaatggcacgatcttggctcactgcaacctccgcctcccaggttcaagcgattctcttgactcagcctcctgagtaactgggattacaggcatgctccaccatgcccgactaatttttgtattatttagtagagacggggtttctccatgttggtcaggctggtctctgaactctgggcaggactaatttagataaggtagtcaggaaaggcatttcttacaaggtggtatttgcatgaatgtagacatatggttgcattttattatatgtaaattacacttcaataaagttgatgaaaaaaatcttacctcatcgtctatgcacttcggattgttgtatttcattctatttaaattacacttgcgtttaaaaaatttaacacttctctaaaacatatctgttgatttgtacttttactaatatgcttatggatgatttatatacacacacacacacacacatatcttttaagaaggttattttaaggttaatcaattgaggctttgtctcaattgattttttttgagacagtctcgttctgtcgcccaggctggagtgcagtggcgtgatctcgactcactgcaagctccacctcccaggttcacgccattctcctgcctcagcctccctagtagctgtgactacaggtgcccgccaccacgcctggctaattttttgtatttgtagtagagacggaatttcaccatgttagccaggatggtctcaatctcctgacctcatgacccgcccacctcggcctcccaaagtgctgggattacaggcgtgagccaccccgcccggctcaattgattcttttgtctcaatttgtagtcagttgaggtttgtctcaatttatggaaacaaatcaaatgtttgttctcaaattcttactctgtcatttattattctccatgtttttgtaactgcttccttggagatatttaaacataaatatatacagagagggtgaagatggaggagtgctttttacagttcacagttgtctttttcatgtgtgacaggtttttgctgtgttgcccaggctggagtgcaatgccacaatcttggctcactgcagcctcaacttcccgggctcaatcgatcccccacctcagcctcccgagtagcaaggactacaggcgcacaccaccacacctagctaatttttgtatcttttgtagagacagggtttcaccatgttgtccaggctggtcttgaactcttgggctcaattggtcctagcacctcagcctcctaggtgctgggattacaggtgtgagccactgtgttcagccaatactcttaacgtttttacttttcacttttaaaaattaactctttttatgaaaaaagtagaattttttaaagagcagagaaaagcacaatgaagacagaaagatcacctgtatattcttattgaccaaagatgatctatttggggtaaatccttttttttttttttgagacgggagttttgctattgttgcccaggctggagtgcaatggcacgatctcggcttaccgcaacctctgcctcccaggtttaaacaattctcctgcctcagcctcctgagtagctgggattacaggcatgcaccaccacgcccggctaattttgtatttttaatagagacagggtttctccatgttgaggctgggcttgaactccagacctcaggtgatctgactgcctcggcctcccaaagtgctgggattacaggcaggatccacgtgcccggccggtaaatccttttaatagaggagtttcaatatttctcctctgccatagtattagaaagaaaagaatcattattgacatctttacgacattgagtttttctcttgtacctggtgtgtctttatttcagtaggtattcttttatgtgctttagtaagtctttatatttttagcataaaagtgtacacatttcttgttttacttatttctagatacttaatggcttttgtttataatatgattgggatattttttctgttgtgtaattgattactattactatgtactaaactgttggtttttgtctaaggattgtaacattgatgaactactttagtagatgaaatggtttcttcatgagattgaattgtctaaagagatgttggtattatttgtaaataaaagtatttgcctattc

SEQ ID NO: 8801 - DNA, 1966 bp, Homo sapiens
gcaactggggaagctgggaggtaggcgcggggcggtcggctgcggtggcggcgtttggatgattgtctctcggcggcggagtcgctcaatgtacttctccagttcctacccttcctcaagtggggaactcaggagaccaagcaggggcaactgtacttcggatggtcaggccccaggatactgtggcgtatgaggacctgtctgaggactatactcagaagaaatggaaaggtctcgcactcagtcagagagccctgcactggaacatgatgctggaaaatgaccgtagcatggcttctttgggtaggaacatgatggagagttcagagctgactccgaagcaggaaatttttaaaggatcagagtcatctaatagcacatcagggggactctttggggtggttcctgggggaacagagactggagatgtttgtgaagataccttcaaagagttagaaggacaaccctcaaatgaagaagggagcagactagaaagtgatttcttggaaataatagatgaggataagaaaaaatccacaaaagacagatatgaggaatataaggaagttgaggaacatccacctctgtcttccagtcctgttgaacatgaaggagttttaaagggacagaaatcctatcgatgtgatgaatgtggcaaagctttttattggagttcgcacctcattggtcatcggagaatccacactggagagaaaccctatgagtgtaatgagtgtgggaagaccttcaggcaaacctcccagctcattgttcatctcagaacccacacaggggaaaagccctatgaatgcagtgagtgtggaaaggcctataggcacagctcccatctcattcaacaccagagactccataatggggagaaaccctataaatgtaatgaatgtgcaaaagcttttaatcagagctccaaactcttcgaccaccagagaacccatactggggagaaaccttatgaatgtaaggagtgtggggcggcctttagtcggagtaaaaatcttgttcgacatcagtttctgcacactggtaagaaaccttataagtgtaatgaatgtgggagagcattctgttccaatagaaatctcattgaccatcagagaacccacactggggagaagccttataaatgtaatgaatgtggcaaagccttcagtcggagtaaatgtcttattcgacatcagagcctccacactggggaaaagccatacaaatgtagtgaatgtgggaaagccttcaatcagatctctcaacttgttgaacatgagcgaattcatactggagaaaaaccatttaagtgtagtgagtgtggtaaggcattcggtctgagtaaatgtcttattcggcaccagaggcttcacacaagtgaaaagccctataaatgcaatgagtgtggaaaatccttcaatcaaaactcatacctcattatacaccagagaattcacactggtgagaaaccctatgaatgtaatgagtgtgggaaggtcttcagttataattctagtcttatggtacatcagagaacccatactggggaaaaaccctataaatgcaatagttgtgggaaagcctttagtgacagctcacagcttactgtgcaccagagagtccacactggagaaaaaccttatgaatgtattgagtgtgggaaagcctttagtcagcgttccacttttaatcaccaccagcgaactcatgctggagagaagccctcaggtctggctcggtcatcttcttaaggcatggttttctgagacagacagcaaagacctttgagttaagctgtctttataagaaggatgttcatcatggtctccttggagaccactaatcacagtggagaccatacctacttgcttttccttgggtcactaaggtgggagagtaggtgcaacttagtctgatccttacttagtaggaaattggggattacatctgtcattaacttgta

SEQ ID NO: 8802 - DNA, 1968 bp, Homo sapiens
gcaactggggaagctgggaggtaggcgcggggcggtcggctgcggtggcggcgtttggatgattgtctctcggcggcggagtcgctcaatgtacttctccagttcctacccttcctcaagtggggaactcaggagaccaagcaggggcaactgtacttcggatggtcaggccccaggatactgtggcgtatgaggacctgtctgaggactatactcagaagaaatggaaaggtctcgcactcagtcagagagccctgcactggaacatgatgctggaaaatgaccgtagcatggcttctttgggtaggaacatgatggagagttcagagctgactccgaagcaggaaatttttaaaggatcagagtcatctaatagcacatcagggggactctttggggtggttcctgggggaacagagactggagatgtttgtgaagataccttcaaagagttagaaggacaaccctcaaatgaagaagggagcagactagaaagtgatttcttggaaataatagatgaggataagaaaaaatccacaaaagacagatatgaggaatataaggaagttgaggaacatccacctctgtcttccagtcctgttgaacatgaaggagttttaaagggacagaaatcctatcgatgtgatgaatgtggcaaagctttttattggagttcgcacctcattggtcatcggagaatccacactggagagaaaccctatgagtgtaatgagtgtgggaagaccttcaggcaaacctcccagctcattgttcatctcagaacccacacaggggaaaagccctatgaatgcagtgagtgtggaaaggcctataggcacagctcccatctcattcaacaccagagactccataatggggagaaaccctataaatgtaatgaatgtgcaaaagcttttaatcagagctccaaactcttcgaccaccagagaacccatactggggagaaaccttatgaatgtaaggagtgtggggcggcctttagtcggagtaaaaatcttgttcgacatcagtttctgcacactggtaagaaaccttataagtgtaatgaatgtgggagagcattctgttccaatagaaatctcattgaccatcagagaacccacactggggagaagccttataaatgtaatgaatgtggcaaagccttcagtcggagtaaatgtcttattcgacatcagagcctccacactggggaaaagccatacaaatgtagtgaatgtgggaaagccttcaatcagatctctcaacttgttgaacatgagcgaattcatactggagaaaaaccatttaagtgtagtgagtgtggtaaggcattcggtctgagtaaatgtcttattcggcaccagaggcttcacacaagtgaaaagccctataaatgcaatgagtgtggaaaatccttcaatcaaaactcatacctcattatacaccagagaattcacactggtgagaaaccctatgaatgtaatgagtgtgggaaggtcttcagttataattctagtcttatggtacatcagagaacccatactggggaaaaaccctataaatgcaatagttgtgggaaagcctttagtgacagctcacagcttactgtgcaccagagagtccacactggagagaaaaaccttatgaatgtattgagtgtgggaaagcctttagtcagcgttccacttttaatcaccaccagcgaactcatgctggagagaagccctcaggtctggctcggtcatcttcttaaggcatggttttctgagacagacagcaaagacctttgagttaagctgtctttataagaaggatgttcatcatggtctccttggagaccactaatcacagtggagaccatacctacttgcttttccttgggtcactaaggtgggagagtaggtgcaacttagtctgatccttacttagtaggaaattggggattacatctgtcattaacttgta

SEQ ID NO: 8803 - DNA, 3857 bp, Homo sapiens
gcccggccagcggcccgcacggacgcactcccgggcgggcgggcgagcccagggggacccggccttgccgcggcgcccgccccgcccccgccccggcccccgcgcggcccggcccaggccgcccgcaggctccgggcacctgtagcccccgaggacccgcgtcgcctggccgccgccgaccccaggcggggccaccccgtggtgccgaccccgggcgccggcctggatcccgctgcccgcgatggtcccggggggccggccctgagccccgcgcgggattcggggccctgcctcccgccccagcccccgccggagagtctccaccaacttctgctcggccgctcctctcagccccttcccttggcccagggcgacctcggcagcccagagggcgtggaccctccggagtgcccagaaagcccccggggtggccctgcgcctcctggctctttctggatggaggcgcctccggaaggagccggctgcacgccgtggccttcacctcgcagcctctgctgaccacacctccctagcgcagaggctgcccgggagcaggaaatgctccaccagccgactcccgggaatcggggtctgaccgccaggatggaagtggggccagccaccgagaccttcgtgctggaacttcaatgtcttgaggatgggggcccagggcctgacaccctctcaggtggcagcggtgggagcgagagtcaggaggaggaagagcctcaggagaggaacagcagtccacagcggccagcagtctcggccccagtgggggccagtgaaatcgctgaggaaacccggccgggacaacgagagttgcaactgcagcagttagaacagcagcccgagccgcagcaacagccgcaacacgagcagctgcaacagccgcagccacacctagaactgcaacagcagccgcagcaagatgggcaacaacagctatctcaactacaacaggaaaaacaccaatccgtgcaccatcaggaactgaaaccagaactgcagctaatgcaccagcagcaacagttacagccacagcaagtgcaagagcaacagcggttgcagcagcagcaggagcagttacagacgcagcaagcacaagagcaacaggtattgcagcagcaggaacagctacagcagcaagtgcaagagcaacagctgttacagcaacagcaggaacagttacagcagcagcagctgctacaacagcaggaacagttacagcagcaacagtttcaacagcagcaggaacagttacagcagcagcagcagctactattgctgcagcagcagggacagttacagcagcaactgttgcagcagcagcaggcacagttacaacagcagctgctggaacagcagcaggcacagttacagcagcagctactgctgcagcagcaggaacagttacagcagcagcagcaacagcagctgttgcaacagcagcaggaacaattgcagcagcaacaactgcagcctcctcccctggagcccgaggaggaggaagaggtggagctggagctcatgccggtggacctggggtcagagcaggagctggagcagcagcggcaggagttggagcggcagcaggagctggaacggcagcaggagcagcggcagctgcagctcaaactgcaggaggagctgcagcagctggagcaacagctggagcagcagcagcagcagctggagcagcaggaggtgcagctggagctgaccccggtggagctaggcgcccagcagcaggaggtgcagctggagctgacccccgtgcagccggagctgcagctggaactggtgccagccgcagggggcggcggagcggcggtcccgggggctccggccgcggtcgtggtggctcccccgggctacgtggtggtgcaggagctcatggtgctgcccgccgtggcagcgccggccgtggtggccatcccgggcccggcaggcagcgcggcgttgacccctgcacggcagcggcggcggcggcgcgctcgggaccggccgaccatctgcggggagtgcggcaagggcttcagccgcagcacggacctggtgcgccaccaggccacgcacacgggtgagcggccacaccgctgcggcgagtgcggcaagggcttctcgcagcactcgaatctggtgacgcaccaacgcatccacacgggcgagaaaccctacgcctgctcctactgcgccaagcgcttcagcgagagctcggcgctcgtgcagcaccagcgcacgcacaccggggagcgaccctacgcctgcggggactgtggcaagcgcttcagcgtctcctccaacctgctgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctgtgagggccgtgatcggggctgcctggccgggaggggaccccccacccgcctccacctgaaaagctccttgacccgggttcatgggcgctggaggcgtcctggaatatccctggagtaaaaggcttccaccatcatcatcatcatcatcttccggattccctgagaaaataccaggttcacagatttcaccgccagaaaaatccatccgccaaaagagaagtggaccggggctgaaacagcacacgggacacgtttgtctgccctttgaggggtctgccaaaggttttccctccgggaaaactggacttactacgaacgaggaaaaacccccagtggcgagacgattaatgacactggccgaggactggacacccaccagggaatcaagacgtggtgagacacacgtggaaaatcttcgatcctggtgaaaatgatcgcaaggagaaattcggggaggaagcaaacttgtttgcactatgtagaaactgaccaaggcatcgaatcgtcctcagaggcatttgccttgaaaatactttccaagatgaaaattcatcagggtgggtataattctgatgaaaacgcctgtgttcatcaacacagggtcagagcgctcaccgggtcgatgtgcaaatccaagccaggaagtcctgctccgggtggaaggtaaaaccttccctccagggaaccaggggctccggcgggcatcggaggcagcttcttggcctctgctgctgtgtcccccagtccccccagcccgcattaatgtcctctggaataagagcctgtggctgaagcagagggccttctgggagagctctccaaggtctggaaggagggtcccccagaaggagctccggggtagccccactgtggcccccctggactccaccagcttcatgcttctcagatgctacccaggggccggcccggggagaccagggcagatttctcccgcaccaggctgtggaggtttggagggctgcctgagcagacactgtgccattgctggggctggggaaagaatatctgagacgacgtttgggagcaatgctctttaccacgttcaccaagtcgtctggggcaggggttgtgagctgcagcagttgctggtgccttgtgggaaggtggggcagggaggaggctgcccgccacctctgcccccagtcacttcctgcttgacctgactcttcacatgtggctgcttaattcctgcccctctccccccagctgcttctcctttactaacacacctgctacattttacacatgtgttggtaagtgagaaacagaaacgaaaaataaattaaaatgcagaaatacaa

SEQ ID NO: 8804 - DNA, 4005 bp, Homo sapiens
aagaggcgggcattcaaagcgcaggcgcacctggctcagttcgcccaccggaatcggcccgggctttcactgctcgcgtccccgagtcagtgcgcaagcgcatttcccccctcctggtccccgccaccgcctcctctttccgatcctccacgccggcgcctcgggaacgggcgcgacttccgcttccgggcgggcgggcaggcgggcggtgcggggctgccggggaggggggagggggcggcacttccggtcgggccctcgggtctccccggagcggcggcgcctcctccgcctcctcggcctcctcccggcggagaccccggcgccgggtctcccgtctcccacccgccggagatggaggcgaacccagcgggcagcggcgccgggggtggcgggagcagcggcatcgggggcgaggacggggtgcacttccagagctaccccttcgacttcctggaattcctcaaccaccagcgcttcgagcccatggaactgtatggggaacacgccaaggcggtggcggccctgccctgcgcccccggccccccgccgcagcccccgccgcagccccctcccccgcagtatgactacccgccccagtccaccttcaagcccaaggcggaggtgccctcctcgtcctcgtcctcgtcctcctcctcctcctcttcgtcctcctcgtcgtcatcttcgtcctcttcctcttcccaagccaagaagcccgatccgcccctgccgcccgccttcggggcgccccctcctcccctctttgacgctgctttccccactccgcagtggggcatcgtggacctctcggggcaccagcacttgtttgggaacctgaagcgaggagggcccgcgtccgggccgggggtgacgcctgggctgggcgctcccgcgggggccccagggccgcttcctgccccctcgcagaccccgccaggaccccccgcggcggcggcctgcgaccccaccaaggacgacaagggctacttccggagactgaagtacctgatggagcggcgcttcccctgcggcgtgtgccagaagtccttcaagcagtcctcgcacctggtccagcacatgctggtgcactcgggggagaggccctacgaatgcggcgtctgcggccgcacctacaaccacgtgtccagcctcatccgccaccgccgctgccacaaggacgtgccaccggccgcggggggcccgccccagcccggcccccacctcccgccgctgggcctcccagcacccgctgccagcgccgccaccgccgccgccccctccacggtgtcctcgggccctccagccacgcccgtggcgcctgccccctccgcagacgggagcgccgcccctgctggtgttggggtgccccctcctgccaccgggggtggcgatggcccgttcgcctgcccactctgctggaaggttttcaagaagcccagtcacctccaccagcaccagatcatccacacgggcgagaagcccttctcctgctccgtgtgcagcaaaagcttcaaccgcagggagagtctgaagcgccacgtgaagacgcactcggccgacctcctgcgcctgccctgcggcatctgcgggaaggccttccgcgacgcctcctacctcctcaagcaccaggcggcccacgcgggggcgggcgccggggggcctcggcccgtgtacccctgcgacctgtgcggcaagtcctactcggctccgcagagcctgctccgccacaaggccgcccacgccccgcccgctgccgctgcggaggcgcccaaggacggggcggcctcggccccgcagcccccgcccaccttccccccgggcccgtacctcctgccccccgaccctcccaccacagacagcgagaaggcggcggcggccgcggcggcggtggtgtacggcgctgtgcccgtcccgctcctgggcgcccacccgctgctgctcggcggcgcggggaccagcggggcgggaggctcgggcgccagcgtcccaggaaagacgttctgctgcggcatctgcgggcgcggcttcgggcgccgcgagaccctgaagcgccatgagcgcatccacacgggcgagaagccccaccagtgccccgtgtgtgggaagcgcttccgcgaatccttccacttgagcaagcatcacgtggtgcacacgcgcgagcggccctacaagtgcgagctctgcggcaaggtcttcggctacccgcagagcctcacccgccaccgccaggtgcaccggctccagctgccctgcgccctggccggggcagccggcctcccctccacccaaggcacaccgggggcctgtgggcccggggcctcgggcacgtctgcagggcccaccgatgggctgagctacgcctgctcggactgcggcgagcacttcccggatctctttcacgtcatgagtcacaaggaggtccacatggcagagaagccatacggctgcgacgcctgcggcaagaccttcggcttcatcgagaacctcatgtggcacaagctggtccaccaggccgcccccgagcgcctgctcccgcccgcacccggcggcctgcagcccccggacggctccagcggcacggatgcggccagcgtgctggacaacgggctggcgggggaggtgggggcggccgtggcggcactggcaggggtgtctgggggtgaggacgcaggcggggcggcggtggcaggtgctggcgggggtgccagttccggccccgagcgcttcagctgtgccacgtgcggccagagtttcaagcacttcctgggcctcgtgactcacaagtacgtgcacctggtgcgacggaccctgggctgcggcctctgcggccagagcttcgcgggcgcctacgacttgctcctacaccgccgcagccatcggcagaagcggggtttccgctgcccggtgtgcgggaagcgcttctgggaggcggccctgctgatgcgccaccagcgctgccacacggaacagcggccgtaccgatgtggcgtgtgcggccgaggcttcctgcgctcctggtacctgcggcagcaccgcgtggtgcacactggcgagcgggccttcaagtgcggcgtgtgcgccaagcgcttcgcgcagtcgtccagcctggcagagcaccggcggctgcacgctgtggcccggccccagcgctgcagcgcctgtggcaagaccttccgctaccgctccaacctgctggagcaccagcggctgcacctgggcgagcgcgcctaccgctgtgagcactgcggcaagggcttcttctacctgagctccgtgctgcgccaccagcgcgcccatgagccgccgcggcccgagctccgctgccccgcctgcctcaaggccttcaaggatcccggctacttccgtaagcacctggctgcccaccagggcggccggcccttccgctgctcctcctgcggcgagggcttcgccaacacctacggcctcaagaaacaccgcctggcgcacaaggccgagaacctcggggggcctggagcaggggcgggcaccttggccgggaaggatgcctgaccgaggggttcccatcccactcccatcaaaagcccccttctggactcccacctcccaggactgatcagactcttcccccctcctcgctgttgccccatccttcagaacttcacacggactggcgaccttcagggcgcacgcccgacaggctcaagactgaatcactcccatcctcgacctctctgccctcccctcatcccatcagacactgaaccctatcctccgtccaaccctcgtttgtgacccgcatcagcccccgccccagcagcactctgcccccagtaagttttggcggagatgggtctgaaccgcccctccccctcctttggaatctggctggacagtggagtatgagcagagttgggagggcacaagggagtgctgggtgctttttggggtgggggggtggggggcggggtggcagacgcggcttgtacagagcggagaataataaatcttaccatgagggcc

SEQ ID NO: 8805 - DNA, 1734 bp, Homo sapiens
gttaaggtctggggctttcttgctccgagagggaccagttacttccgccgtagctgctgttgctctgtcgactgcgctgtgacctgcactgttcacgggacctttagagaggacgccagaatacctggaagccaggaaatggattcggtggcctttgaggatgtggctgtgaacttcacccaggaggagtgggctttgctggatccttcccagaaaaatctctacagggaagtgatgcaggaaaccttgaggaacctgacctccataggaaaaaaatggaacaaccagtacattgaagatgagcaccaaaatcctaggagaaacctaagaagacttataggggagagactctctgaaagtaaagaaagtcatcagcatggagaagttttgacacaggttccagatgacacactgaagaagaaaactcctggagtacaatcatatgaaagcagtgtgtgtggagaaatcggcataggtctttcatcccttaataggcacctcagagcctttagttattccagtagccttgcaatacatggaagaactcacactggggaaaagccttatgaatgtaaggaatgtgggaaagcattcaggtttcccagttctgttcgtagacatgaaagaatccactctgcaaaaaaaccctatgaatgtaagcagtgtgggaaagcattcagttttcccagttctgttcgtagacatgaaagaatccactctgcaaaaaaaccctatgaatgtaagcagtgtgggaaagcattatcttatcttgtaagctttcagacacacatgagaatgcacactggagagagacctcataaatgtaacatatgtgggaaagcctttttttctcccagttcgttaaaaagacacgagaaaagtcacactggagagaaacgctataaatgcaagcaatgtgataaagccttcaattgtcccagttcctttcaatatcatgaaaggactcacagtggagagaaaccctatgagtgtacacaatgtaggaaagccttcagatctgtcaagtacctgcgagtacatgaaagaaaacacactggagagaaaccctatgagtgtaagctatgtggtaagggatttatttcttccacttcctttcgctatcatgaaaagactcacactggagagaaaccttatgaatgtaaaaaatgtgtgaaagccttcagttttgtcaaggatcttcgaatacatgaaaggacacacactggagagaaaccctttgaatgtaaacaatgtgggaaaaccttcacttcttccaattcctttcactatcatgaaaggactcacactggagagaaaccctatgagtgtaagcaatgtgggaaagccttcagatctgcctcagtccttcaaaagcacatacgaactcacacaggagagaaaccctatggatgtaagcaatgtggtaaagtctttagagttgcctcacaacttaaaatgcatgaaaggactcacacaggagagaaaccctatgagtgtaagcaatgtggaaaagccttcatttcttctaattctattcgctatcataaaaggactcacactggagagaaaccctataaatgtaaacagtgtgggaaagccttcatttcttccaactcttttctctaccatgaaaggattcatactggagagaaaccctatgagtgtaagcaatgtggtaaagcctttagatctgcctcaatccttcaaaagcatgtaaggactcacgctggctag

SEQ ID NO: 8806 - DNA, 496 bp, Homo sapiens
ggaagcagattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccagggtcttgctctgtcacccaggctgtcgtagagtggcaatcatcagtggcaatcgtggcttaactcatagcctcaaactcctggtctcaagtgatcctccttcctctgcttccgaaagtggtgggattacaagcatgagccactgtaccctgcaaaaccacactttgagtttctgtttgggagctctctgcaagtgagagaattctttgggaaaataaaagtttaaatcctgtga

SEQ ID NO: 8807 - DNA, 2230 bp, Homo sapiens
cgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagagagcagctctaaattgggaagcaatgccggaaacaagtctcttaaaaatcaacttggattaacctttcagttacatctgagtgaactgcagctatttcaagctgaaaggaatatttctggatgtaaacatgtcgaaaaacctatcaacaattccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagacttgctaacaatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacagaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgtggcaaggtcttcaatcgaaatgcacaccttaccagacatcaaagaatccatactggagagaaaccttatgaatgtaaagaatgtggcaaggtcttcaggcacaagttttgtctaaccaatcatcatagaatgcacacgggagagcaaccttacaaatgtaatgaatgtggcaaagcatttagagactgttcaggccttactgcccatctactaattcacactggagagaaaccttacaaatgtaaagaatgtgccaaggtcttcaggcatagattatccctaagcaatcatcagagatttcatactggagagaaaccttacagatgtgatgaatgtggcaaggacttcactcgaaattcaaaccttgcaaatcatcacagaatccatactggagagaaaccttacaaatgcagtgaatgtcacaaagtctttagtcacaattcacaccttgcacgacataggcaaattcatactggagagaagtcttacaaatgcaatgaatgtggcaaggtcttcagccacaagttatacctaaaaaaacatgagagaattcatactggggagaaaccgtacagatgtcatgaatgtggtaaggacttcactcgaaattcaaacctggcaaatcatcacagaatccatactggagagaaaccgtacagatgaaatgtgtgtggtaagatctttagtaataattcacaccttgcacagcatgagataattcattcatgagagagttcttacaaactgagtatggcaaactcttcatgctaagttctagcattaatcaacatcagagattccatactaaagagaaatcatagcaatgtatgtgaatcaggtctcttgaggcctgccaaatgactagatatcaaaacatacatcttggatgaaaccatacagatggattatgtatgctgaggctattattcaaggaccattactatggaacatgataagatttacacaagcgataattcagtctctagttctccaatatttatgatactgcatgctgcagaaaagtcacagctccaaatacgttgaatctcatgacgcgatgcatgtcgaaggtccaagggcatgtggaaatggtcagttatattcaggcaattaaaaaacctaattatatggggttttttgaaaa

SEQ ID NO: 8808 - DNA, 1635 bp, Homo sapiens
atggcagttatggacctatcctccccatgggctttaactaaacaggactctgcctgtttccatctgagaaatgctgaagaggaaaggatgattgctgtatttctgacaacctggttacaggaaccaatgactttcaaagatgtagctgtggagttcactcaggaggagtggatgatgctggattctgctcaaagaagtctgtacagagatgtgatgttggaaaactatagaaatctcacctccgtggaatatcagttgtacaggcttactgtgatctccccattggatcaagaagagataaggaatatgaaaaagagaattccccaagccatctgtccagaccagaagattcaacctaaaaccaaagaatcaactgtgcagaaaattttgtgggaggaaccatccaatgcagtgaaaatgataaaactcacaatgcataattggtcctccacattaagagaagactgggaatgccataagatcagaaaacagcataagattccagggggacattggaggcaaatgatatatgccccaaagaaaacagtacctcaggagctattccgtgactatcatgaattagaggaaaactctaaacttggatcaaaacttattttttcacagagcattttcaccagtaaacattgccaaaaatgttactcagagattggatgtttgaaacacaattcaatcataaacaattatgtgaaaaactctataagtgagaagctctatgaaagtcatgaatgtgatacaactctatggcattttcagagaaatcaaacagtacaaaaagagtacacatattctaaacatggaatgcacttcacacataatatgtttcctgtacctaacaatttgcatatggcacagaatgcctgtgaatgtaataaagatgaaacgctgtgtcatcaatcatcccttaagaaacaaggacaaactcatactgaaaagaaacatgaatgcaatcaatgtggaaaagccttcaaaaggatttctaatcttactttatacaagaaaagtcacatgggtgagaaacaatatgaatgtaaagaatgtggtaaagtgttcaatgattcctcaaccttaaggagacatgtaagaactcacactggagagaaaccctatgaatgtaatcaatgtggaaaagctttcagtcaaaaaacatcccttaaggctcacatgagaactcacactggagagaaaccttatgaatgtaatcagtgtggaaaatcctttggcacaagctcttaccttatagtgcacaagagaatacacactggagaaaaactctatgaatgcagtgagtgtggaaaagccttcaacacgagctctcaccttaaagttcataagaaaattcataccggagagaatgtttatgaatgcagtgactgtgggaaagttttcagtggggtctcatcccttagaatgcatataagaactcacactggagagaaaccctatgaatgtaaggaatgtaggaaagccttcagtgtttcctcttcccttaggaggcatgtgagaattcacactggagagaaaccctatgaatgtattcaatgtggaaaagccttcagtcagagctcttcacttattatacacaagagaattcatactgagagagaaaccctgtaa

SEQ ID NO: 8809 - DNA, 4757 bp, Homo sapiens
gaagacgccaagatggcgacgagtcagtatttcgacttcgcgcagggcggcggcccgcagtacagcgcccagcctccgacccttcccctgcccactgtgggggccagctatactgcacaacccactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtacttccagtctgctgccctccagtctgggcgcatgacagccgcagactccggccagccagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcgtgacctcctaccccccgccctcctacaaccccacctgcaccgcctacacggcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccagacctaccgggaacatctgggagggcagaagcacagaaagaaggaggcggcccagaagacaggcgtgcagcccaacgggagcccgcgcggggtgcaggcgcagctgcattgcgacctgtgcgccgtgtcctgcaccggggcggacgcctacgcggcccacatccggggatccaagcaccagaaggtcttcaagctgcacgccaaactggggaagcccattcccaccctcgagcctgcactggccacagagagcccccccggggcagaggccaagcccacgtcccccactggccccagcgtgtgtgcctcgagcaggccagcgctggccaagagacccgtggcctcgaaggccttatgcgaggggcctcctgagccacaggcagcaggctgcagaccccagtgggggaaaccagcccaacctaaattagagggtcccggagcacctacccaaggaggctcaaaggaagctcccgcgggctgctctgatgcgcagccggtgggcccggaatatgtggaggaggtgttcagcgacgaagggcgagtgcttcgcttccactgcaagctgtgcgagtgcagtttcaacgaccttaacgcgaaggacctgcacgtgagggggcggcggcaccggctgcagtaccggaagaaagtgaacccggaccttcccattgccacggagcccagcagccgggctcggaaggtcctggaggagcgcatgaggaagcagcggcacctggcggaggagcggctggagcagctgcggcgctggcacgcggagaggaggcggctggaggaggagccaccccaggacgtgccgccccacgcgccgcccgactgggcccagcctctgctcatgggcaggccggagtcacccgccagcgccccactccagcccgggcggcggccggcgtccagcgacgaccggcacgtcatgtgcaagcacgccaccatctaccccacggagcaggagctcctggccgtgcagagggccgtgtcccacgcagagcgggccctcaagctggtgtccgacacactggccgaggaggaccggggccgccgagaggaagagggtgacaagcgcagcagcgttgccccccagactcgggtcctgaaaggcgtcatgcgagtaggcatcctggcgaaaggcctcctcctgcgtggggacaggaacgtgcgcctcgctctgctctgctccgagaagcccacgcacagcctgctgcggaggatcgcccagcagctgccccggcagctccagatggtgaccgaggatgagtatgaggtctcctccgaccctgaagccaacattgtcatctcctcctgtgaggagcccaggatgcaggtcaccatatctgtcacctcacctctgatgcgggaggacccctccacagacccaggtgtggaggagcctcaggctgatgcaggtgatgtcctgagccccaagaagtgcctcgagtccctggccgccctccgtcatgccaggtggtttcaggctcgagccagcggcctgcagccatgcgtgatcgtcatcagggtcctgagggacctctgccggcgtgtgcccacctggggggccctgccagcctgggccatggagctgctggtggagaaggctgtgagcagtgcggctgggcccctgggccccggggatgcagtcaggcgagtcctggagtgcgtggccacagggacgctcctgacagacgggcccgggctccaggatccctgcgagagagaccagacagatgccctcgagcccatgaccctccaagagcgggaagacgtgaccgccagcgcccagcacgccctgcgaatgctggccttccggcagacccacaaggtcctgggcatggatctcctgccgcccagacaccggctgggggcccgcttccggaagaggcaacggggacctggcgagggagaggagggcgcaggggagaagaagcggggccggcggggcggagaggggctcgtgtgagccgcctacctcccccacctgcgggcctttgcatccctgcactcctggacgtgtgcgcgccgaccaatggctgcttcatccccgacgttggacaatggtcatttccttttgagtaacgctctgtaggtttcctttaaaacacctgtgcttcagaccgggcactgtggctcatgcctttaatcccagcactttgggaggctgagttgcttgagcctgagagttcaaggccagcccagacaacagagtgagacccccatctctccaaaatatttttaaaaatcagcttggcatggttggtggccaggcgcggtgattcacgcctgtaatcccagcactttgagaggccgaggtgggcagatcgcctgaggtcaggagttcgagaccggcctggtcaacatggtgaaaccctgtctctagtaaaaaacacaacaattagcctggcgtggtggtgtgcacctgtagtcccagctacttgggaggctgagtccggagccttgaggccaggagggcagtgagctgtgattgcaccgtgacactccagcctgggcaacagaagaagactttgtcacttaaaagaaatgttttttaacatttgtgcttaaattgttacagaaatgacaccatccagccctgggagtggcaccccttcctcgagggccccatcccccacagccaggggggccagcagtacagcaagcagattctaaactcgggggcatcttgctggctctaaactcacctcgtggtacaggaaggggttttaaaatacttcctctgggctgcgcatggtggctcacacctataatcccagcactttgggaggccaagcttggtggatcgcttgagcccagcggtttaagatcagtctgggcaatatggtgacaccccatctctacaaaaaattagccagttgtggtggcccaagcctgtagtcccagctactcgggaggctgaggccgtaggatcccttgagcccaggagttcgaggctgcagcgagccgagattgcgctactgaactccagcctgggttacagagcgagaccctgtctcaaagaaacaaacaaacaaacaaacaaacaaacaaaactttctttggatgcggctgcggcatggatttgaaatcacgtgggcaggccctgttctggggccccaccacatgtgcaggacaagcccaggggagctcccagccggcatccccacgcccccagcccagcctgctccaaacagaccccccacccacctccacagccaggatgtcagcagggcctgagccaggctcgtcccctgtggggagagccacagggccaggtggacacgccgacgggcgatgaggatcctggctgggcctcccccgggaacagctgtgctggacagtcagacccggagcccagaggcacccccacccaccccccgccccgagccctgtaccactgagtgcctttcacagagaaaacccactctgccatgtgtcactgaggcctggatttgagcttccgtccttccttcctccctctctccctgatgtaggccttggctggccctgaggcagggggtccccaatccccccttgtggtagcagggcccgggacccgtgcctgggggacccggggaggggccgccgtcttgtggatgctggccatggtgggcaggcgcctcctggcactgatggatgtgggggcacccccttctgagtccccaccccaacctgttcaaaccttccgcttggtcagtttttttttctttggccagctgcccagtggcattgaatgagaaaagtccacctttgggcagatgtgatctccagccagtggctcagttttgtttctctgtgtttgaaggacagcctgcatgtggctctgtctgaatgtctttgtagagctacctggaaattgggaggcagggggaataaaggaaatcatttgtc

SEQ ID NO: 8810 - DNA, 1377 bp, Homo sapiens
aagacgccaagatggcgacgagtcagtatttcgacttcgcgcagggcggcggcccgcagtacagcgcccagcctccgacccttcccctgcccactgtgggggccagctatactgcacaacccactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtacttccagtctgctgccctccagtctgggcgcatgacagccgcagactccggccagccagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcgtgacctcctaccccccgccctcctacaaccccacctgcaccgcctacacggcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccagacctaccgggaacatctgggagggcagaagcacagaaagaaggaggcggcccagaagacaggcgtgcagcccaacgggagcccgcgcggggtgcaggcgcagctgcattgcgacctgtgcgccgtgtcctgcaccggggcggacgcctacgcggcccacatccggggatccaagcaccagaagggcctcctgagccacaggcagcaggctgcagaccccagtgggggaaaccagcccaacctaaattagagggtcccggagcacctacccaaggaggctcaaaggaagctcccgcgggctgctctgatgcgcagccggtgggcccggaatatgtggaggaggtgttcagcgacgaagggcgagtgcttcgcttccactgcaagctgtgcgagtgcagtttcaacgaccttaacgcgaaggacctgcacgtgagggggcggcggcaccggctgcagtaccggaagaaagtgaacccggaccttcccattgccacggagcccagcagccgggctcg

SEQ ID NO: 8811 - DNA, 866 bp, Homo sapiens
gaagacgccaagatggcgacgagtcagtatttcgacttcgcgcagggcggcggcccgcagtacagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccaggagagccacccagctgagccccatctggccaggagagccatccagctgagccccacctctgccaggattgccacccagctgagccccgccttggccaggagagccacccagctgagccccgcctgggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttgg

SEQ ID NO: 8812 - DNA, 1225 bp, Homo sapiens
ttttccgtgggagtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccgctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaaggcatggatagagtccagtgttctggtgatctacaattggctcaccagcttcagcaagaagaagacagaaagaggagatctgaagaatcaagacaagaaatagaagaatttcagaagctgcaggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaag

SEQ ID NO: 8813 - DNA, 2195 bp, Homo sapiens
ttttccgtgggagtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccgctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaaggcatggatagagtccagtgttctggtgatctacaattggctcaccagcttcagcaagaagaagacagaaagaggagatctgaagaatcaagacaagaaatagaagaatttcagaagctgcagagacaatatggtttagataattctggaggatacaaacaacaacaactacgaaatatggagatagaagtaaataggggaagaatgcctccatctgaatttcataggagaaaagctgatatgatggaatcattagctcttggttttgacgatggaaaaacaaaaacttccggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaaggtatgttgattccttgcattccaaaaattcaatctatgattgaagatgcatggaaggaaggttttgatcctcagggggcctctcaacttaataacaggttacagggaacaaaggcctggattggagcatgtgaagtatatatactcctgacctccctaagggtaaagtgtcatattgttgattttcacaaatcaactggtcctttgggtacacaccctcgcttatttgaatggatattgaactattattcttcagagggagaagggagtccaaaggtagtgtgtacatctaaacctcctatctatcttcagcatcaaggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttgccaggagacaagcttctcaagtctttacagccgagaagattccttgaagaatcaagcatttaagcatttcagtgattgagaacaatactttgttttctaaatgtagatattgaactccttaatacaattatgaatctgtgaattctcttaagtcttaacatataatttaatttctaaaatgcctgtgttaattgaattatacctatcatacttcattgtttggtaaattatttcaataaaatgtcttgtttttgcattgtg

SEQ ID NO: 8814 - DNA, 1798 bp, Homo sapiens
cccttacggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcaaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctc

SEQ ID NO: 8815 - DNA, 550 bp, Homo sapiens
cccttacggcgccggagagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgaggtgattgatcacttaggctgttcacactttgtatatctgtttaagtgctatacaaacacatgaactagtgtcactcttctgttgctcatagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacag

SEQ ID NO: 8816 - DNA, 567 bp, Homo sapiens
attgccggcagcgaggtgatccgggagcttccagcccccatccccggccgcgggagaccagggctccgctttggctccgcggatggtggcggcgggtgaagggaggccacaaggctgggcagggcctgaggagcggggtgggagcgtttcttctggggctgcagtgagatcgattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatg

SEQ ID NO: 8817 - DNA, 570 bp, Homo sapiens
agatggcggagttggacatcgggcagcactgccaggtggagcattgccggcagcgaggtgatccgggagcttccagcccccatccccggccgcgggagaccagggctccgctttggctccgcggatggtggcggcgggtgaagggaggccacaaggctgggcagggcctgaggagcggggtgggagcgtttcttctggggctgcagtgagatcggttgattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaag

SEQ ID NO: 8818 - DNA, 664 bp, Homo sapiens
cagagaaaagttgaaaagaccgacaaagactgtgggaagttggcttttatccacactagggacggtcccaggaacgaggaactagtttgtgaatggctcaaagaaaagcaaaccgatgtccaggggtcttgtgcaggacctgaaagtattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaat

SEQ ID NO: 8819 - DNA, 882 bp, Homo sapiens
gaggccaccgctgggacgtcggctggccggcgccacccggccctctgggagttgagcgagagcagagaaaagttgaaaagaccgacaaagactgtgggaagttggcttttatccacactagggacggtcccaggaacgaggaactagtttgtgaatggctcaaagaaaagcaaaccgatgtccaggggtcttgtgcaggacctgaaagtattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgaggtgattgatcacttaggctgttcacactttgtatatctgtttaagtgctatacaaacacatgaactagtgtcactcttctgttgctcatagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacc

SEQ ID NO: 8820 - DNA, 772 bp, Homo sapiens
acggcgccggagagatggcggagttggacatcgggcagcactgccagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagatt

SEQ ID NO: 8821 - DNA, 614 bp, Homo sapiens
ggctggccggcgccacccggccctctgggagttgagcgagagcagagaaaagttgaaaagaccgacaaagactgtgggaagttggcttttatccacactagggacggtcccaggaacgaggaactagtttgtgaatggctcaaagaaaagcaaaccgatgtccaggggtcttgtgcaggacctgaaagtattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacag

SEQ ID NO: 8822 - DNA, 1705 bp, Homo sapiens
ccggagagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcaaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgta

SEQ ID NO: 8823 - DNA, 540 bp, Homo sapiens
gattgtccccaagggaaaggctagaggcagatgggctcccgcctgtgggccagaccccagcctacctcgcttattctgcgtgccgtgcttcttggccagggcgatttctctctggattcgattttccagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggtttt

SEQ ID NO: 8824 - DNA, 2048 bp, Homo sapiens
agcggagcgttgtcggccagtgccttccgtgaagttgctcgccgggtcgttgggccctgtcgacctgtaggcgggcgagcgagccagcggacaagactgcgggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagatcttcaaatcccaagatgatgatcgttttgcaaaattccaacattgcctgtttacctggtttgtgatgtgtctgggtttcatggatattatcatggccccggttgcatcctttctcagaatataagtagttctgaaatccagtcattcattcaacaaatacgtattgagcgtctactgaatggtcagtgcaatgttccaagtatggtagacatgggagagaaagtctctgcttcatgacagtgcctacaataaatgtgtaaagagtcgatgtaactcctaatggttgtaagtgctatgcagaaaatagggtaggaagggccctcgaaaaagatgacattagtggagacttgattgatgagagggttttattaagcacaagaagagacggcagtattcacattggtccctgagtcaggtatgtcacatgaattcccatgaagtggaggagactagtcagagcatcctcttctgtggacctcattttgaggaagtccttcagatttatttgatccttcactaaccagaaaaccgaaggataagtattgattctactcctggcttgcttccacatgtcaaattatatccctatgtttaataattttggttagaaaataggattattgccatctttttcttagctatttcaagaggatttaatgagatatgctactttggctgttggactgctttttataggttagagaaaaacaaagttaataatgttagggccttttagcactcctgataccagagacttttaattaattggatttaggtaattgtcctatgtgacatttatagtaataactataaatgtttatagtaataactatgtgatgtttatagtaataactcttgaagtagcacaagaaccctgtgtttactgaaccattatgttaagatagaattatatagtgtttaatgccatgtgaactctattgtattacatttttgaaagttggttatttgtgcgtagtactactttaaaccaaagtgtttaatcaaaacacctacttttcttattagaactaaaattattttatatgtttatgaggagtgtgatacagattctgaggtaaatatatatattttttacttttctttttttttttgagacggagtcttgctctgtcaccgaggctggagtgcagtggcatgatctctgctcacttcaacctctgccacctgggttcaagtgattctcctgcctcagcctcccgagtagctgggattacaggcagtggtattgaggtcaggagtttgagaccagcttggccaacatggtgaaaccccatctctactaaaaatacaaaaattagctgggcatggtggcgggctactcaggaggctgagacatgagaattgcttgaacctgggagacagacgttacagtgagtggagactgcgccactacagtccagtctgggtgacagaggttacagtgagtggagactgcgccactacagtccagtctgggtgacagagtgagactctgtctc

SEQ ID NO: 8825 - DNA, 3241 bp, Homo sapiens
cggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcatta

SEQ ID NO: 8826 - DNA, 3265 bp, Homo sapiens
caggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaagacccaggagatcctactgaagtgagtggctggccgagtccagtgaccacatcagcacattcagtaatgactcttgaagcttttgtctgccctaaatgatttggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttc

SEQ ID NO: 8827 - DNA, 1955 bp, Homo sapiens
ttttatctcttgatgtaatatggaaagtggagcattaacttacaaaagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacag

SEQ ID NO: 8828 - DNA, 2079 bp, Homo sapiens
gtgaagttgctcgccgggtcgttgggccctgtcgacctgtaggcgggcgagcgagccccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttc

SEQ ID NO: 8829 - DNA, 2094 bp, Homo sapiens
gtgaagttgctcgccgggtcgttgggccctgtcgacctgtaggcgggcgagcgagccagcgcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttc

SEQ ID NO: 8830 - DNA, 909 bp, Homo sapiens
cagatactttggtgttgaacatttgggatagaagagagaaatttaaaattaaaaattttccatatttctatcacaaatattggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtgg

SEQ ID NO: 8831 - DNA, 2988 bp, Homo sapiens
cctctgccataattcttttgtctttgttacttttacagaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcagaagacagagaatggattccagaccatagcttaagtgaatatgctgataatgcaattgtcttgggtgttctgcagggtgctcagagtccatcatcaagtagaaaacagcaaaagatgggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaagggcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtca

SEQ ID NO: 8832 - DNA, 3250 bp, Homo sapiens
cggcagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcaggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaagggcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtcacactagttagtatcatcaattgaacctataattacactgtttattttctggtttttaacatttatagaagttctggtatcttcaaaaatttgcaataaaagaaaaaaagaggaccaaaaataaaa

SEQ ID NO: 8833 - DNA, 2954 bp, Homo sapiens
cctctgccataattcttttgtctttgttacttttacagaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcaggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaagggcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtcacactagttagtatcatcaattgaacctataattacactgtttattttctggtttttaacatttatagaagttctggtatcttc

SEQ ID NO: 8834 - DNA, 3185 bp, Homo sapiens
tttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcagaagacagagaatggattccagaccatagcttaagtgaatatgctgataatgcaattgtcttgggtgttctgcagggtgctcagagtccatcatcaagtagaaaacagcaaaagatgggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaagggcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtca

SEQ ID NO: 8835 - DNA, 746 bp, Homo sapiens
agctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcagaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaa

SEQ ID NO: 8836 - DNA, 2311 bp, Homo sapiens
gcttccctagaagtgggaggaaaccagaactggaggtgccctccttctgggggtaggagtcagctaatagacatccaaggtgtgcaggagtgctttcactctgcgcaggaaagatcagagagaagtccagagccttgcctgcttgtgatcctggtggagaaggtggagtatggtgagctgcttgctaaggacagccaggcaacgctgtgtttgtgaagatgtgctccaccttctcctctgtgcatcccagctcctcctgctgaaacagctgagcttgctttttggatttcttagactcctggcctctgagagacacctctaaggacaaactgaccttgcattgggaactttattatccagatcctcataggctttgtctactctggattgcttgttgcaacagttcttaggaagcaagattgtctcctgcaccagcatctgcctgtgtttgcttttacctactttgagcaagacccagtgaggccctagctctgttggtcctgaaaagcctgaaccctgaggctgtttctcctgcctccaaaatgcaattataggaaataagaagcacagaaacagtggaaacaaccaggaggagaaacaagaaaacctaaaattttcaatattcaaaaatacctgtcgtggtggttgatgcagaaaacactgagttcatcaaagagctttgtaattgttggaccagagaacccctttgctacaggaactgatatgttttgtctttctggcctagtcaagggaggataagtaagtatctggggcatggaaggaatgcactcttgggctgttttgcttgtatctgactcacccctgactctccagtgaagcagaaaggaagaaacctcacaccacccaggtgtggccagactttggccattattgtgaatccccaagagttaccacaggcccttcccaaatatatatttaatcttgtggttcaaataagcttttggctcacatctaagcacatcataaagaacgctgtagaagaggtgacatgatgaggcgggaagacgaggaagaggagggaacaatgatgaaggcaaaaggggacttagagatgaaggaggaggaagagattagtgagacaggagaactggttggcccttttgtgagtgctatgcccactccaatgccccacaacaagggcacccggttctctgaggcatgggaatatttccacctagctcctgctcgtgctgggcaccatcccaaccagtatgccacctgccgcctgtgtggcaggcaggtgagccgtggccctggggtcaacgtgggcaccactgcactgtggaagcatctgaaaagcatgcacagagaggagctggagaagagtggccatggtcaggctgggcagcgccaggatccaaggccccacgggccccagctccccacaggcattgagggtaactggggtaggctcctggagcaggtgggcaccatggctttgtgggccagccaaagggaaaaggaggtgcttaggagggaaagggcagtggaatggcgggagagggctgtggaaaaaagggagcgagccctggaggaggtggaaagggccatcctggagatgaagtggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaagtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagcttgttctgtgtgacccagcaagtggaaggacaaagaactgtgagcctcagatctttggacctttccaatgcgtctctttctcctgttattgctgcaatgtattttcttgcttatattaaagttgtttcatcagta

SEQ ID NO: 8837 - DNA, 6172 bp, Homo sapiens
tttcagagcgactcccctaccgctttcgggcgaaggccacacgtgacggcccccctttccccgcagacgtgtgaatgcagcgctgtgtctttaaggggcacgcgcggaggttttccgtccgggacaaaatgtcagcgaggcgcctggagggggatctaccatctcggactcccgacccgccgccggctccggccgcgtttcccgggtaaagggcactgctgatggttcttcagaactcaggaatcgtgttgcatgcattgtttctacccacctgagatggttggaaaccctgaggcaatgacagggaccccagaatccttgggaaattacccactgtctaatttaaagcgtgcgggcgccgcagaatgaggagtggcgagccggcctgcaccatggaccaggcccgcgggctggacgacgcggcggcgcggggcggtcagtgtccgggactggggccggcgccgacgccgacgcctcccggccgcctgggggcgccatactccgaggcctggggctacttccacctggcgccggggcgccccgggcatccgtcgggccactgggccacctgccgtctgtgcggggagcaggtgggccgcggcccgggcttccacgcggggacctcggcgttgtggaggcacctgaggagcgcgcaccggcgggagctggagagcagcggcgccgggagctccccacctgccgcgccctgcccgccgccgcccggccccgctgcggcccccgagggcgactgggcgcgcctgctggaacagatgggcgcgctggccgtgcgcggcagccggcgggagcgggagctggagcggcgcgagctggccgtggagcagggcgagcgcgccctggagcggaggcggagggcgctgcaggaggaagagcgcgccgcggcccaggcgcgccgggaactgcaggccgagcgggaggcgctgcaggcgcggctgcgggatgtgagccgccgtgagggcgccctgggctgggcccccgctgcgccgccgccgctcaaggacgaccccgagggtgacagggacggctgcgtcatcacaaaggtcctcctgtaggggtgtggccacttccccaccccaggacagcgcttctccgtccaatgccaatgccttcagaccccgctgggaccgaagccgtaaccgaagccaggcccgcagccgctactcactcggaagctccagctaactgtaggatcttccacaccctaaggcttcagcttgagaagcacttcgaagccagagcagaaccaaaactcacttccatggggtcaccgggggtgcctgggcggcctttcgtgggcatgcacgcaaggaattggggtggcacacgggacacccgagagctccaggagccccgtgaacccagaccacccagtgccatggccacttagggctgggaacccgaacctggtgactttgaaaggatagagcttcattccataccaaagacttatcacaccatgtgcctatacacccagcagcccaaggtggagggtgcgtggaaatgagaaagctttttacccaaaaaaaaaaaaaaaagagttcctaatgcataatctgcccaacaccaagttctgaagggtgggtgagggacgtcccctctagtttccatgactgctgtagacccgcatcatctctagccctcatcggggcagtcccagagcccgcttttttactgcccatattattcaaccaataccaggtgcactctgtctcccctcggccatccttcccttgcttcagacctaatgacaagtgtggcacatatgtccactttcaggcctcacatctgccaccttagcaagacatcacctcatccccttgtcactaggaagagggcttcttccccacatgtcgtcatagtgctcacctctgggctgaaggggaaagcatccctccgcttaaggccacatctacctgtcattttccatcccattcctctcccacgtttactgggtctttcctcctgtagtattccccctttcgctgtctcagtccctccctttcccccaggctcttcttcctcagcaatgtgcagtctccctttcttactgaaaagaaagacttaacccagaagggccaacaagtcctggctgcctatccttcctccccagtttttactccctcactctgggtcagttttcttttctttttttctttatgtgtgtatatattatatatatatatacatatatacatatatatatacatatatacatatatatatacatatatacatatatatatacatatatacatatacatatatatatatatatatatatgtatatataatactttaagttctagggtgcatgtcagttttctatgcttcaccagactatttccaagctgccacaatctcccagtgaccaaatatgatgatctatttgcagccttcattttgcttaatctctcccttgaaattgctctcttggtaggtggatcctgtttttccttcaaagaattccttttcctgttgcatactggttcccagtttttccataggcctcttttttttcttatttttttatattgaaaaattccacacatccagaaaaagttgaaaggctagcacaatgaatactcagatacatactctccacttggattgaatagttgttaacattttgccagatttactattctctccaccccatgcatgtgtacatagaatgacatttcgacccctgagtattaccacatagatttcctgagcacaaagacaccgttctacatgattacattaagatgatcatgcctaaaaatataaacagtaacttctttatagcctctaatacagagcccttaatcagtattcaacaattgtctccagaatgtttgtctttaaaaacaacgacaacaaccaggtcccatcaaggttcatacattcttttggtttcaactctagtcactttcagtctacaacaaccccaacatattttcccatgatactttttgaagcatccaggccagctgtcttagcaaatgtcctctattctggaagtgtctgattgcttccttaggcctatgtctacactccactcgtggctcatatccctgcagagttgtaatctcctctgggccagggactcctgaatatctccaggccgagtgttctccccgggcctggagaaaaccttcatgcccaatcccttgctgcatgtctccacccctccttgcacatcctgcctctatgagtggacgaggcaaatctactcaaccccacatcccacccctcacctgataactaacatttactgggcactaacaatgtatcaggcacatactacacacttaacatgcattgctttcacataccagctccatggtaacattgcgctggctttacagctaaagaaactgagctagaaaggggttaagtatcctgtacaagatcacagctggccagcaatagaggtgggatcccactgcagacagtctcccccacagatgccatgctcccactgtaccaccatgtactgcttcctgagatctctgcttccttcagtcgacccagctgacacctgtttccttcctaactccaactaattaattccagttaatggaattgactggaattagtgacattaatatttactgagcattccccatgtgtcatcagagctgtgctaaatgctttacaagaataattacctgccataaagcaaccctatgacataggtgctactatgcccattttgtagatgagacaggttcaggggagttagtatcaccttcaagtcatacagtggctaagaatctgtggtctcgctgaatgctgggcgcctgctctgctaagtctatttctacaaaacattgcactgccttcctgttgcctgccaagctcagggcccatttatcatgcatcttcccatccttgtctcccccaactgtcccttacctgagtcacaatttcgccaaagccaaagggattgtcctaagccaatgttgatttatcactcttcctgctcaaaagcccccaagatcacctatcaatcacctacttgagtgcaagctttgactctgtcacctgacattcaagtccccctctgcccccatgccagtcttatcccctcccctacatatgccctatcctgcagccaaattggactctgttcttcctgacaagacctggtattggcatctctatgcctcagtttgccttccctccactttaaaaagcctcttcagtctcgatacaaaaaacatcccacacatgttctaaaaccatgctttccttgatttctcctcatgtcaagacatttcttacttctctagtctcctagcattttgtgcctcacaaccctcaggacaggccagctagtgtatggctgtgggtttttatctcacctcccctgcctgaccctgagcccttgtggggagtatactcaccctactcctacagtgccttgcattccgtagctgctcagtacattaacccattcaatgtctttaagatttttacaagttagttttcctgtaattactaatcatttatctttaattctgagtaaaattcacaacaacaaataaaaggaaatagtagtaattttttaagctgtttagtcaataaagatttaatgcgtcagttattggactgtttggtttgaagccaatcaaccattctggtatgtaaatctacttttttattatacaagtaacacaaaatgtattgcctcagtcaaggaagaagaacagaaaaaaacaacaccccaaaatcctgtcacctctgtaaaactgctattaattaacattttaatatattttcttttgtcttttgcaatttttatattactctaagttattttcaagtattggaacttaacttcttcatatggatttataaattgggctagatgatctgaatttcctttttagaaggaaaaaaaaagacttccacaaatgttactcttctatctcaccaattgtaagaaccattaaaacataggaaaggatttagaatcttaactactccctcaaagatggctagtgcgagcctgaatgtcctgttcaggagacagagaacaattaacctgagtgctgagttaagggaagaggtttttactttctgctttatacacttctgcattgttgtaattttttacacaaagtatgaattacttttatgataaaaaaattttgtttgtagacaacattcctctccttcagcattcagcatccttagttaaaataaaatctccaacgaaagcatggatataatccccatttccagaaaatcccagaaagaaatgcagcccttgttcagtccaactccatcatttgatagattaggaaaataggttctagagagtgacttgtccactgtcaggagatggtgactgtggcgcgtcatctgactccagcctacttaatgcatttcagtctctttggccttaagggctcctgctgctcacctgaaatcattcccaaggaacccacaagagcaggttccctgggaggattcctgagaacacctacacacaagcctcagagatctgccaagacattctctttctgataaatactattaaatatttttctatcaaatagttgccaaatgacctgctccagtcaaaactcaatctgacttgtgactacaaagtaatctgaggaatcccaaaggtatataaaaatctatccatctaagtcatctctcttcaaagtagaagacctggaagactatacagttattcccaaaatgcttcaacatttctggaactcctcttttagagtggccatgagtccctagcacattctttaaaacatccttgagttggcaaatactcctctttccaggataaatttgattttttaaaagaactgccaattattcagtctggtgaatatggtagatgattaaccagattaacatttctggttaataaggtgagattataataaaacaatgataattattttagtgtggctcataaattggtcttgatagtggtatattaaggttaagtaaaggcagcatggtcaccatacagattaaagcccattttagttggtttatgatgtgaatgaattcaggtagcactgggagtcattatatgtttaaatagtattaaaggtttctttttataaaaatcttaattatgacattctctgaaatctggtttcacagtattaaaatgaggctttaaggaaaaaca

SEQ ID NO: 8838 - DNA, 542 bp, Homo sapiens
cgcctggagggggatctaccatctcggactcccgacccgccgccggctccggccgcgtttcccgggtaaagggcgtgcgggcgccgcagaatgaggagtggcgagccggcctgcaccatggaccaggcccgcgggctggacgacgcggcggcgcggggcggtcagtgtccgggactggggccggcgccgacgccgacgcctcccggccgcctgggggcgccatactccgaggcctggggctacttccacctggcgccggggcgccccgggcatccgtcgggccactgggccacctgccgtctgtgcggggagcaggtgggccgcggcccgggcttccacgcggggacctcggcgttgtggaggcacctgaggagcgcgcaccggcgggagctggagagcagcggcgccgggagctccccacctgccgcgccctgcccgccgccgcccggccccgctgcggcccccgagggcgactgggcgcgcctgctggaacagatgggcgcgctggccgtgcgcggcagccggcgggagcgggagctgga

SEQ ID NO: 8839 - DNA, 7285 bp, Homo sapiens
tcctagtgagtatcgagttggtcttattatcgcgtgaactgggagcctttgtttcctgcgtgtcgcaggaagtgacgtttcgggtacagccgctaccagagtccctttctcgcgaggcggaagaaccccgatcgctgaggagcaagggggcgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggattacaagataaagaacaaaatttaacaagaagaattagtacctcagatattctgtctgaaaagaaacttggtgaagatgaagaggaactatctgaattacagcttcgccttttggctcttcagtcagccagtaaaaaatggcaacaaaaagaacagcaggtgatgaaagaaagcaaagaaaagttgactaagacgaaaactgtacagcaaaaagttaaaacaagtacaaaaacacattcggccaaaaaagttagcactacagctaaacaagcattgaggaagcagcaaacaaaggcatggaagaaactacaacaacaaaaagagcaggaaagacagaaagaagaggatcagcggaaacaagctgaagaagaagagagaaggaaaagagaggaagaaatcagaaaaattcgagatctctcaaatcaggaagaacagtacaatcgattcatgaaattggttggtggcaagaggagatcaagaagtaaatcttcagatcctgacctgaggcgatccttagataagcaacctactgatagtggaggaggcatttatcagtatgataactatgaagaagttgctatggatacagatagtgaaaccagttctccagctccttcaccagtgcaaccgccatttttctctgaatgttcattggggtatttttctccagcaccatctctttctttgcctccaccacctcaggtttcttctctgccacctttgagccagccttatgtggaaggcttgtgtgtttctcttgaacctctacctcctctaccaccattaccacctctcccacctgaagatccagaacagcctccaaaaccaccttttgcagatgaggaagaggaggaagaaatgctgcttcgagaagaactacttaaatctctagcaaataaaagagcttttaagccagaggaaacatccagtaatagtgacccaccttcacctccagttctgaacaattcacatcctgtgccaagaagcaatctatcaatagtcagtattaacacagtgtctcagcctaggatacagaatccaaagtttcacagaggaccccgtcttccacgaactgtgatctcgcttccaaagcataaatcagtggttgtaacactaaatgattcagatgatagtgaatctgatggagaggcttccaagtcaacaaatagtgtttttggtggattagagtccatgattaaagaagcaagacgaactgctgagcaagcttcaaaaccgaaagtacctccaaaatctgaaaaagaaaatgatcctctgcgaacaccggaggctttgcctgaagaaaagaagattgaatatagattgttaaaggaagagattgccaaccgtgagaaacagcgtttgattaaatcagatcagctgaagacaagttcatcatccccagcaaactctgatgtggaaattgatggtattggcaggatagcaatggttactaagcaggttacagatgcagaatcaaaactgaaaaaacataggattctcttgatgaaagatgaatctgttttaaagaatttagtgcaacaagaagctaagaagaaagaatctgttagaaatgctgaagcaaagattacaaaacttacagaacagcttcaagcaactgaaaaaattcttaatgttaacagaatgtttttgaagaagcttcaggaacaaattcacagagttcaacagcgtgttacaattaagaaagctttgactctaaaatatggagaagagcttgctcgggcaaaggcagtggccagtaaagaaataggaaaacgtaaactggaacaagatcgctttgggccaaacaaaatgatgagactggacagttctccagtatcaagtccaagaaagcattcagcagaactaattgctatggagaaaagacggttacaaaagctagaatatgaatatgccctgaaaattcaaaaattaaaagaagcccgtgcccttaaagcaaaggaacaacaaaatatctctccagttgtggaagaggaacccgaattttctttacctcaaccctcacttcatgatctgacacaagataaattaaccctggacactgaagaaaatgatgttgatgatgaaattttgtctggttcaagcagagagcgaagaagatcttttttagaatccaattattttactaaacctaaccttaagcacactgatactgctaacaaagaatgcataaacaaacttaataaaaatactgtagaaaaaccagaactttttctagggttaaaaattggtgaattgcaaaaattgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatagccattgctgctgagattgttctaaagggacaaagagaggtccaccgtttatatcagagagccttacagaagttacctctttgtgcatcactgtggaaagatcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaatatttgaactgctttgtattgaaatactactttgtagtattgaaattgtttatatacttttttaatataagttaactttctaaaaactcttgctgtctttattcacttttcacactggtgggaaagggttgaagtcggagatacggatattcaccataacttatagcaatacttttttatcttgaaactgctttcccattaaaaaaaaaaaaa

SEQ ID NO: 8840 - DNA, 1771 bp, Homo sapiens
gggggcgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggtaatggaattaaatatttcagttagtaatgactcttcttcctctaaagtagtaactacttgttttggcagtgtacttcattgaaatgattgtaattatctgtaaattcttttgtactttctatgtagacattcatatcattgaataattactaattttgtttacttttagtctttatttatttatttattttttgcctgacattctggcctctataatagaatgttatacataagtgataatagtggacacctttgtttcctaatttaaagaaaatggttttgacatttaccattaaatatgatgttaatttttttgtaggtatcccttatcgggtaaaggagggttttactcctattcctggtttgaaattttcagcgtgaatggatgttgaagtttacaaaatctgttttcttcattattgggatgagcatctaatttattttaatttgttagtgtaatgaattatataatttatttctagtattaaaccacccttgtatgcttgcgtttaatacagtttatgatataccatttttaaa

SEQ ID NO: 8841 - DNA, 2363 bp, Homo sapiens
gctgtcggagctcagaccagcaggcctacgacctagaaagtgctcaaaaccccacttcctaaggcctagaaggagcgacgtgaagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 8842 - DNA, 2184 bp, Homo sapiens
caggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattta

SEQ ID NO: 8843 - DNA, 2081 bp, Homo sapiens
cctgaagctccggactacagctcccaggcctctccaagcccctaccgcacaggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggt

SEQ ID NO: 8844 - DNA, 2637 bp, Homo sapiens
attgtgtctattgtatcccttggctggtgtatttgtacatctctcgggacgtgaaattgacagtgaaaagtatggcagatgagcaagaaatcatgtgcaaattggaaagcattaaagagatcaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggt

SEQ ID NO: 8845 - DNA, 2178 bp, Homo sapiens
ggttggaagccccgcccttccgaggagtttcccaaaaccctgcgcggccggctttgaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 8846 - DNA, 844 bp, Homo sapiens
aagccgcccaaagcggggttgcgccggggcctccggggccgaggtgggcctgctcattggaagatcgcatcgcagccatgagcagtaaggatttcttcgcgtgtggacactctggccattgggctcggggatgccctagaggaggagctggagggcgaagaggtggaggccatggcagaggttctcaatgtggttccaccaccctatcttacacctgttactgctgtggtgagtccggtcgtaatgctaagaactgtgtccttctcggaaacatctgctacaactgtgggagaagcggccacatcgccaaagactgtaaggatcctaaacgagagagacgccaacactgttatacctgcggcagactaggacatctggctcgtgactgtgatcgtcagaaagagcagaaatgctactcttgcggcaaacttgggcacattcagaaagactgcgcccaggtcaagtgttaccgatgcggcgagattggccacgtggccatcaattgcagcaaggcgaggccaggtcaactgctaccgctgcggcaaatcccgacatctagccaaggaatgtcccagtgaggttaccacttaaatcttcccccccaccccccacccttttgctgattgataattgtattattttctccgaaaacttcactcaccgaaaggtcgatagattgaggctactctcaggcaagtgagctttaattaccatgttaaaggaggaaagagctagaaaaaaaaacctcaaaaaagttaatcattggtagatgccccacaattaacgtgttgcttctgccccacgggcaaatctagttattaaatagtcattctgagcaccaatc

SEQ ID NO: 8847 - DNA, 7102 bp, Homo sapiens
aggccaacaacccggccgacctgggcagcctcaccaacctgacggacgaggtggtgcgcagcaagctgctggtgtcgctggcgctgctgggctcggagcagcgcgaggcggcgggcgtgctctaccgcacgctcacgcacatcgactccatcatccacaactacgggctgcagcttaacgagggccgcacgggcgatgagttcctgctgctgttcaccatggcctccaaccacccggccttcagcttccaccagaagcaggtgctgcgccaggagctcacgcagatccagagcagcctgaacggcggcgggggccacggcggcaagggcgcgcccgggccgggcggcgcgctgcccacttgcccagcctgccacaagatcactccaagaactgaggcccctgtcagcagtgtcagtaatagtttggagaatgccctgcacacatcagcacattccacggaggagtcgctgcccaagaggcccttaggaaaacacagcaaagtgagtgttgaaaagatagacctgaagggattatcacacacaaaaaatgacagaaatgttgaatgttcctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccggaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaactaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccaggtaggtgtggcactggccatgtgccacgtctttgccctttgtagtctgtcagatattaaagtttctaaccctgtttttttaatctccaagaatggggaaagtggaatgtagagatggaagcagaacgtgatgtttggatacaacagctatttaatccttttttattttttaagcaaaacactcagttttctaccttattttctaatgttgatttcatggtaatactgacagttggaagtgtttaacataaaaactcattgctaaagagcactgaggaaatgggagctagcgcacttgtaataaaaataaagacaaaatattttcttgaatgcatatatgtgattgggtattttaaaaaccagtatcatctgtcatctccaaaagattacaggagtcagcttgttaatacagtagtgttagtaggttctgtatttttaattcagtacttagaattctaggtcctttattgcccaaagtcagcacagttagtttataccacagactctgtcttggggcacagtagtggggcggggtagtgactttgcctaaacatcacccagctggaacagaggctgagcggggctttaggcacttgccagatgggaactgggttgcaccctccttgctccctgtcattttcttgtcactcttcctgcttcccagtgttttattttatgccttgctcgttgtacatcatgatgactgatggtcttcaaggttgtgaggaaagccgtctccctgcttgactcgactgctgtcccagaggagagtcctgtgcgacctgagcgggggtggctgccatttccagcatgcaggtgacttccaaagaatgagtcaggtggcactgaaagccatgggttctgaagaggcgaatttgttgaaaagtcccaagggtctgaatgaaagcatctttaatcaacactcaacactcgcaatattctagaaaaccatatactgtgctggttgaggccaaaggttaacattgctccactgttcaccaaggaagggggcagtggccatccgccgcggcctcacgtgcgttgtaacaagccctcatcacatgtgtgagtcttacgtgcacaaaaagagaaggctttggtactgaaactggacaccttgtgtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatgtttttatgagtaaatttaatgtactgaaaataaaaattttaaaaaaggctg

SEQ ID NO: 8848 - DNA, 2747 bp, Homo sapiens
gaccattggccttttccatgaagaagaggcaacattgagtggcggacaacactttttggcatctctccaattcagctgttagcatctcctagtgtcttcttcacagctaacagctttggctacttgctcatgacactccgtctctgatcacagagcaaatccactgtctccattggtttccagtactagtactcaattctactcaatcccacctgattccaggagacataatggagaagtgcacgaaatcatcatctaccatgcaggtagagccttcctttcttcaggcagagaatctgattctgcggcttcaaatgcagcatccaaccacggagaacactgctaaaaggggccaagtcatgcctgccctggccaccacagtgatgcctgtaccatactcacttgagcatctcacccagtttcatggtgaccctgccaattgctcagagttcctcactcaggtgactacctacttgacagctctccaaatctctaatcctgcaaatgatgcccagatcaaactcttttttgattacctatctcagcagttagaaagttgtgggatcatatctgggcctgacaagagtaccttactgaagcaatatgagaatcttattcttgagttccagcagtcatttggtaaacccacaaaacaggaaatcaatcctctgatgaatgctaagtttgacaaaggagacaactcctctcagcaggaccctgctactttccacctcctcgctcaaaatctgatctgtaatgaaaccaatcagagtggtcagttcgaaaaggcactagctgatcccaaccaggatgaagagagtgtcactgatatgatggacaatcttccagacctgatcactcagtgcattcagttggacaagaaacatagtgacaggccagagctcctacagtcagagacccagctcccattgttggcttccttgatccaacaccaagccctctttagccccacagatccaccacccaagaaagggcctatacagctgcgagaaggccagctgcctctcaccccagccaaacgagcccgccagcaagaaactcagttgtgcctctactgcagccaatctggtcacttcacaagagattgccttgccaaacgttctcgagctccggcaacgacaaataacacagctcaccagtaagaggagaccaggaaagtcactttttaaacttacatcccagccttactgatttataacctgcattaacttttaaaatacagatggggaactgtgacaccactttataggcagttatgaactgacacgctttgggggaatttaaacaatcagatcttgttcattggcaaattacccctcacgaaacctaacccgagaatgatgaaaacaattcacaggcactttctgcagttgggattaattctccaagagcaccaaaaacctgcaggcaaaactttgcccagtctgagccaatgaaaataaccgtggaagcacattgggaaccttatcctgaccaatgggtgacatctgggttgagtttgtgtcccaaatcctgaatcttgtgtgcctagaaatgagcccaagacttttaccttcacctttattggtctgtatcctagtttcctgttggcttaggacctttggctgaagtccaaatgacattcctataatctgcttatattctcctcctagagtttggaccatgcttcacctattgactacgatctaccttcagcataaatcaaccttcctggaaccacagctctgccacccttccatagagctatatgttttgtttccatctaaagactcatgctttcccaacaaacagaacctcctggctatttacaaaccagattgaatgggcatttgaatactgcttggaactgttggtccctttttctttgcaggctagcccatcaggcaggtgtatgcttttagccaagcccaccaattccaacttattcctctcttctccaacaaccctacttgaggttccagcatgtcttatagccaagtcaatatgctctaggataaggatttctgaaaggtatttagtgagagttggggatggtgtgtcataattactgtatctgtagcatgtccttgctgccttggacaagggacctggccaaataaatctccactgaagactgacagccagaccctgcagtagtttctaactctagaagcctcaatgtagtcaccatctaggattactactcattgctattgagctctacctttatggaccacctctgaagtccttcatctaattgaggatcttaaaaaacaatgaatggcaaaaaacttcctacactatctcatctgaaaaatcctggggcacatacattaaaaccatttgtgcacaaaactcaggaagtcgggattttattgcttatgttttactcttggtacacaccagctttgtgtagattcctgatgcttctgaacaaaagtagtgttatgctagaaaggcaaaactccctaaaatgttaaaactgttcagcaatgatcactgctggtaattaccagccctctgttccctgcttcttgtttctgatgtatgtccccaaaatggatatcctggagaaatatcagtaatcacatattccctagcaaccatcaaggcctctcagaacatgaaatcccattgtactttggctttgtttctggagaattatgctaactttgacaatacttaaacctaactaggaccttactactctgattctgtagcaccaataaatagatattttcaccttg

SEQ ID NO: 8849 - DNA, 906 bp, Homo sapiens
acccatctgtggccttcacttcctccccttgtgggggttttctctgcaaagatgcaagaggtgtgttcgggggaggacacacatgggggtcactttccttccagacctgggcacaccggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggacaaaggcaagcaaaagcccatgtccaggagccctgggtgtccccacagg

SEQ ID NO: 8850 - DNA, 4933 bp, Homo sapiens
cgcagtcggggggaggcggcggcagcggcagcggctgcgggcagcgcgcggggcgcagggcgcggggcgatcaccgtcggggctcgggaggcgggcagtgggcacaggctccccggtgcccgcccctccgctgcggaggggggccgcgagcgggcggccggggaggggccggcaccgccgccacaaaatgagcctgctgtcggccatcgacacgagcgccgcctcggtgtaccagcccgcccagctgctcaactgggtctacctgtcgctgcaggacacgcaccaggctagcgccttcgatgccttccggcccgagccgaccgccggcgccgcacccccggagctggccttcggcaagggccgccccgagcagctgggctcgcccctgcactccagctatctcaacagcttcttccagctgcagcgcggagaggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggacaaaggcaagcaaaagcccatgtccaggagccctgggtgtccccacaggctcgcctctgagagcctctttggggtgagcagccttgtattggccacaggtgcactaaattgactgtgaatcccaaacctccccagaccagccaggccgcctgcccccacccagaaccttccggtttgccctgtatggaaagccactctcagaaatccctctttcctgagtcagcaatcgtggcaaggggacatgtgttccaacagcggctggggagtggacctctctgtcccttgcccaccttaagccccaaatccagaccccctctgacatcactggcattgcacctgggtgtgcccccctccccacgctatggacccagataggaggggttaggcatgggggaggcacagaatgctggagagatgcgtcctggtgaacgtggggcagcccctcccacgacccccaccagactgccttaggttttgtcagccccactccctttccttcccctctgcctcccacccactctgggggtccacatcaagatagctgggcccagtgtggaagcccagcgtgtctgttccagcagaaaggacacaagcctggtgttctggagacctcggctcaagtctttgccctgctgccgacgcattgtgtcaccttgggcaaggacttcgcatctccaggcctcagtttccccattagttaaatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaaccctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggagttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccgaaaaaatcttcacagtaattttttgtctgtatatatttgagggcctttttttaaaaaaaaaaaaagaaaagaaaaatataattgtttgatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggttggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagcaaaa

SEQ ID NO: 8851 - DNA, 3229 bp, Homo sapiens
ttctggggaaacggaaagctaagttttaattttgctattgcttttgcttttttaacagaaaaggtacaaaaaagaaaaaatgggagagatgttgccgaactccgtcccgcctgtgggctgtgggccgttagcaaagctgctagcatgaaatcgtcgagcaccgcttgcgaaacgccaaatcctcgagagcgaggccggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaagagaggaaacgggggcggccgcagcttctgccccccgcgcggcccgcggcccggggcgaggaggccgacggcggccgcgagaagatgggctgggcccaggtggtgaagaatctagccgagaagaagggcgaattccgcgagccgcggccgccgcggcgggaggaggaaagcggcggcggtggagggagcgccgggctcggcggccccgcgggcctggcggcgccggacctcggcgacttcccaccggctggccgcggggatccgaagggccgtcggagagatccggccggcgaggcggtggacccccgcaaaaagaagggcgctgcggaggcgggcaggaggaagaaggccgaggcggcggcggccgccatggcgaccccggccaggcccggcgaggccgaggacgcggccgagcggcccctccaggatgagccggcggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttatccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaa

SEQ ID NO: 8852 - DNA, 2648 bp, Homo sapiens
atttacacatttccctcctcagcaatgggtacacagacagccaagctcctggactaagtctctgaatgtgtatctgacacttccccttactgagctccggaggctccttcttgccgagctccggaggctcccagtgacctcttgataatcagccttggcggggcccaaataccaccccttggaaaactcactgagcctgacatctgcctgtaagcagctttcaggaaggatctcacaaacacccacccaatctctcttggtagcaaattgtcaaatcatacccatttcctcaaaagatggtggaggacttagcagcctcctatattgttctgaaattggagaatgaaattcggcaggctcaagtgcagtggctgatggaagaaaatgctgctctccaggcccagatcccagagcttcagaagtcccaagcagccaaggagtatgatctactccgaaagtcctcagaggccaaggagccccagaagctcccagagcacatgaatcccccagcagcctgggaggcccaaaagaccccagagttcaaggaaccccagaagccaccagagccacaggatcttctaccctgggaacccccagcagcctgggaactccaggaggccccagcagccccagagtccctggcgcctccagcaacccgggagtcccagaaacctccaatggcccatgagatcccaacagtcttggagggccaggggcctgcaaacacccaggatgccacaatagcccaagagcccaagaattcagaaccccaggatcccccaaatattgagaagccccaggaggcaccagaataccaggaaactgcagcacagctagagttccttgagcttccacctccccaggagcctctggagccttcaaatgcccaggaattcctagaactctcagcagcccaggagtccctggagggtctaatagttgtggagacatcagcagcttcagagtttccacaggcccctattgggttagaggctacagatttccccctgcaatacactttaaccttcagtggagattcccagaagcttcctgagttcctggttcagctgtatagttacatgagagtcagagggcacctgtatcccactgaagcagccctggtgagctttgttggcaattgcttctcaggtagggcaggatggtggttccagctcttactggatatccaaagccccttactggagcaatgtgaaagtttcatacctgtgctccaggatacttttgataatccagaaaacatgaaagatgccaaccagtgcatccatcaactctgccaaggggagggtcatgtagcaacccacttccacctcattgctcaagagctgaactgggatgaaagcactctctggatccaatttcaagaaggtcttgccagttctatacaagatgaactgtctcacacaagcccagccaccaacctatctgatctcatcactcagtgcatcagcctggaagagaagcctgatcccaatccattagggaaaagttcctctgcagagggagatggacccgagagtccaccagctgaaaaccaacctatgcaggctgcaatcaactgcccacacatcagtgaagctgaatgggtccgttggcacaaaggccgcttatgcctctactgtggttatcctggtcattttgccagagattgccctgtcaagcctcatcaggccctgcaggcgggaaacatccaggcctgccagtaagggggaccccacgtgggccaatctacaaatatgcgtccccctctcttccaatatccatgtctcatacactatggcttactgttgaaatccaactgggaagaagataattctttgagcaagcaatggtagattcaggctcctacagaaacagcattgatcatactgtggttcttcgagagaagctgcccatccgcagtaatatcttccctctgatgctggaaactgtcgacggccatccacttattaatggacccataactaaggaaacatcacctgtccaagttcaaattggaaaccatgttgaagagctccagtttgacattattcatgcaccacgataccctctgattattggaatccattggcttgagacacatgacccaaacatagaatggagtacccgcactgtgtcctttctatcacgttattgtcactacaattgcttcaggcacaggtggaatagaagaaatcgtgatgaaataatttctgggtagatcctgtgtcctagtgactgttcctggcaacctgtcttctgttacctcagctgtcatcagcatttgctgctccctgaatcttctactgaacatcttgctatgtactaaggctacctgtacaacgactctgcctcttagatgatagactgaacctgatgactttgagctgcttttttttttttcactaactctgcatgcctctatctcagaactctgcatcctgcggaactgttttaattacaattatactaacaatacacatgagaatagatattagaaactaataatgaaaaagcatagctgttaaactgacttgatttttttcttatcaatattttctatatcacaaaaatggcaacatcttttacataaagaaaataagtttgtaagtgatatttcttaaaagaatcaataaatattagcaatttct

SEQ ID NO: 8853 - DNA, 5724 bp, Homo sapiens
aggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtggtatcatccctactctgcagataatgatagcgaccattttttgaacactgtgtgccaggcactgtgctaagcactttacagacactatctcactcagtcctcccaacaaccctatgaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaagatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgtaa

SEQ ID NO: 8854 - DNA, 611 bp, Homo sapiens
cgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccaggtattttctagatttgtttttctatttaactacctaaaagtacctcattcatttctcctaccaatagtaattttcatcaaataaaaatttatttaccatgtcatgaa

SEQ ID NO: 8855 - DNA, 958 bp, Homo sapiens
gggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatgggtataaaacattttttttgcttatatatctgaacagattttattacaggtccacaattaaattttgcataatttcaaaatctagacacctaaccagaactgacatggatttatttattctactcatgtgaatattcatacctttcactgctgaaatactaatgtgtttgatttcagtatgttgccctataacctgcttagggatattattacctttctagactgcaaaatctcttaatttttgaaatatgtatggtcctgagacgaacaagagactgaccctgtaaatttaccatttggtacattctttctttgggtacagttttctaaattgatacttgaatttacatatcacctccagacagacagactgtgggaagcatttggttcactgtaacttactttctgtttctaatctatttctccccataacctgtaaaacaaaaaaatatataaacattgaaattgctacctgtaccacaagatgcagaacctagtagtcatctcttgaataatattttgacattattttaaagatgaa

SEQ ID NO: 8856 - DNA, 2262 bp, Homo sapiens
gatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgt

SEQ ID NO: 8857 - DNA, 4939 bp, Homo sapiens
aagtggggccgaaggaaaacacggagagggagcccggccgggacaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgtaa

SEQ ID NO: 8858 - DNA, 5533 bp, Homo sapiens
aagtggggccgaaggaaaacacggagagggagcccggccgggacaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaagatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgtaa

SEQ ID NO: 8859 - DNA, 5379 bp, Homo sapiens
acaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaagatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtacttttt

SEQ ID NO: 8860 - DNA, 4988 bp, Homo sapiens
aggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaagatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtg

SEQ ID NO: 8861 - DNA, 1219 bp, Homo sapiens
cctgttcgcagctgcggcagtgagtatgtgtgtgacggacccccgccgcccgcggctcgggacccctgcctaccctccttcttgcccgccgggctgtggaactagcgcgtgccccctcgccggcctcgacgtctcccgtccgcccctcactcgtggcagggcgcagctcctggagaatctgagcatggggaataaagtcaggaaggatcgcaagtgaggattatattaatatgataattagcacgcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggccaagaataaaatctttatgaactaacaagatgaattaaagatggaatgattcatttctatggttaggttttaattaatacatgggggatgattttggcactttttcaaagaatttgtttctgtgtatctgaatttgcacctactctgtaacctaactgcgatttataaaatgaaacaatctcttctaatttggcacttgataggtgctttgactttaaaaggcaagtgtatttttctgtcacgaatatcttgtcattctaaaataagtaaaaacaatggattgatgaaacttcttcactgcttttttctttgtgtataacaaatacattgatattttactg

SEQ ID NO: 8862 - DNA, 2619 bp, Homo sapiens
ctccttacctcatttgtcctcgcccctccccgtccctctacgcgttttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggttttgtttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaa

SEQ ID NO: 8863 - DNA, 1381 bp, Homo sapiens
cctccccgtccctctacgcgttttggttcccggttggtgcttcctgttcgcagctgcggcagagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggttttgtttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgtttt

SEQ ID NO: 8864 - DNA, 2862 bp, Homo sapiens
gcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccaagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataatct

SEQ ID NO: 8865 - DNA, 2904 bp, Homo sapiens
ttgcactccagcctgggcgacagggtgagactgtgtctcaaaaaaaaaaaaaaaaagttgaaaggattctacagtggacatccatagatttattccaaattctaaagttgttaacagctcgttatactgcattctctttatcacatagtggttgttgaaaggtttgacaggaacactgatgcttcaataatggttttggttcagtttgttagtctgttgaacttcaggatcgtgtcttagaatatatgttcgaaaggataaaaaccgtactttaattttgggtttcaaaagcctacccctgcaacaaaatagaagctcaataagtgtgtcatcctcaaaatatccgtgggtcttttgtctttataatattctgacaccaaaagtgagagaagtagtagttgaattttatgatttgcattgttaaatgagggcttatcttccttaacaaataataacatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataatctaagactttgaatacaaaaaa

SEQ ID NO: 8866 - DNA, 1250 bp, Homo sapiens
attccaagtgctttctgtcacccgccggcggaccgagagtctagggttcggggcgcgcaggctgcctcggcgcagacctcttcccctcagggaggccgtctcctgaccagacccactcctgcctcccacccgggtgccgtgtttagggttattttaggctgctcacctgacagattgtacacaagcccttaattgcccccctctgtttgaggtcgtggtgaggtttcatatttcgcagccacgctcaaattgtgccgtcatgttacagttgtaggtgatgaaataccggctgcttagacgcgggatcggtttttataccggggcaaacgctagtggtcccagaatgcagagttgggggcctcaaggaatccgggtgtgctgagataattggttaattgcttgattaaaattggggattaattttagagttcttccactcggagctcgcttctgtgctgaagatgctttgcaacgccttgaggaaaacgcgccaaagaagtttctgttagacttgagttacaagattgcagatttttcttgatttgctatggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccaagtatcctacatagtgaatgaagatcttttatgcatcttgccactaagttcacctttaaaacaatttccaaattttgcagaccatgataactattccttaataaaattcactaaaggtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcag

SEQ ID NO: 8867 - DNA, 4393 bp, Homo sapiens
ggcagcgccaggcgtggggccggggcagcgccgggcgagggcgagggcgcgggcggaagttccaggagggccagaattccaagtgctttctgtcacccgccggcggaccgagagtctagggttcggggcgcgcaggctgcctcggcgcagacctcttcccctcagggaggccgtctcctgaccagacccactcctgcctcccacccgggtgccgtgtttagggttattttaggctgctcacctgacagattgtacacaagcccttaattgcccccctctgtttgaggtcgtggtgaggtttcatatttcgcagccacgctcaaattgtgccgtcatgttacagttgtaggtgatgaaataccggctgcttagacgcgggatcggtttttataccggggcaaacgctagtggtcccagaatgcagagttgggggcctcaaggaatccgggtgtgctgagataattggttaattgcttgattaaaattggggattaattttagagttcttccactcggagctcgcttctgtgctgaagatgctttgcaacgccttgaggaaaacgcgccaaagaagtttctgttagacttgagttacaagattgcagatttttcttgatttgctagtatgtttttttttacgttcgtagagttttataggtagatagataactttggttcgggtagttttccttttaaaatttgtagagaactgaaagtggctgatatgttagcttttttagggggacggggtcggggaatggagtctcagtctgttgcccaggctggagtgcagtggcgcgatctcggctcactgcaacctccgcctcccgggttcaagcgattctcctgcctcagcctcccgaatagctgggattacaggcgcccgccacggcgcccagtcagtatatcagtttttaaggtttgtgaagcgcgatttattttttcagaatgtcgtcttcctccacattgtgaggaaaattttcagaatacaaaaagttgaggccgggcgctgtggctcaagcctgtaatcccagcactttgggaggccgaggcgggtggatcatgaggtcaggaggatcatgaggatcaggtggatcatgaggatcaggaggtcagcctggccaacatggtgaaaccccgtctctactaaaaatacaaaattagccgggcgtggtggcgcgtgcttgtaatcccagctactcaggaggctgaggcaggagaatcccttgaacctgggaggcggaggttgcagtgagccaagatcacaccattgcactccagcctgggcgacagggtgagactgtgtctcaaaaaaaaaaaaaaaaagttgaaaggattctacagtggacatccatagatttattccaaattctaaagttgttaacagctcgttatactgcattctctttatcacatagtggttgttgaaaggtttgacaggaacactgatgcttcaataatggttttggttcagtttgttagtctgttgaacttcaggatcgtgtcttagaatatatgttcgaaaggataaaaaccgtactttaattttgggtttcaaaagcctacccctgcaacaaaatagaagctcaataagtgtgtcatcctcaaaatatccgtgggtcttttgtctttataatattctgacaccaaaagtgagagaagtagtagttgaattttatgatttgcattgttaaatgagggcttatcttccttaacaaataataacatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccaagtatcctacatagtgaatgaagatcttttatgcatcttgccactaagttcacctttaaaacaatttccaaattttgcagaccatgataactattccttaataaaattcactaaaggtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataatctaagactttgaatacaaaaaa

SEQ ID NO: 8868 - DNA, 4606 bp, Homo sapiens
ctccaataccgcaggagggcggtcttccccggctcgccaactcggctgctctgggggattcgtgcgcggtaagaagctgcgcggtagcgcggtgaggtgaggttctcagccaccaaagctgcagggtctcgtcgttcgttccctctggcctggcggaacttgcgtgggaagctgggaggacagaaggcttagccgctgggtccctgagctggctggagcgcgggctgtctaggggcggcgacctcagctgttgggctccggctgctgggggctgtgcgtccagccgccctggaatccgcctgtgggtgggccgcttggctctcccacttcaccctcttgataacccagagcctcccccttcccacgtacgtaggggaaggataatctacttccttttgaacagcttcggtccccactatgacagtcgcataaacttcagcgaagagtgcgctggtaaagtggcatggagtttctcacaccaattcattgggtccacccttcagcttctgtggaaggggtctttctgttactaggagctgagacttggggggttgccagggatgctggtcttaaaaggtgataatttaggccgggcgcggtggctcacgcctgtaatcccagcactttgggaggtcgaggcgggcagatctcctgagctcaggagttcgagaccaccctgggcaacatggtgaaaccccttctctactaaaatacaaaaaattagctgggcgtggtggcacgcgcctgtaatcccagctattcgggaggctgaggcccgagaatcgcttgagccctggcggcagaggttgcagtgagccaagatcgcccactgcactccaggttgggctacagagtgagactccgtctcaacaacgaccacaacaacaacaaaaaaggtggtggcttaatacagccatgctccccttaagaactggtatagttatgagaaatggttgggccgtttcgtggttgtgtgaacatcatagtgtacttgcacaaacctacacagctgggccgtatgggatagcctgttactcctagtctacagacctgtacagtataactactaaatactgtaggcagttgtaaaaggatggtgtgtatctaaacacagaaaagatactgtaaaaatatagtgtaaaagaaaacatggtacagctgaatagggcacttacgcatggagcttgcagggctgtcggtagctattaagtgagtcagtgagtggtatgtgagtgtgaaggcctacgatattatttagggtattactgtacactactgtagactttataaatgcggtatgcttagtctaagtttattaaaaataaggtaataaccttagcttactgtgcttttttaactttataaacttttaaattaattttaactccttgaccttttttttttttttttgagacggagtttattctctctgtctctcatttttgagacagagttttgctcttgtcacccaggctggagtgcagtggcgcaatctcagctcactgcaacgtccacctcttgagttcaagcgattctcctgcctcagcttcccaggtggtgcgcgcctgtagctgggactacaagagtgcgccaccacgcccagctaatttttgtatttttagtagagatggggtttgaccatgttggccaggatggtctcgatatcctgaccttgtgatccacctggccttggcctcccaaagtgctgggattacaggcgtgagccaccatacccggcccactcttttgtaataacacttagcttaaaatgctaatgtgttgtatagctatataaaaatattttctttattcccttacattattctatagctttttcctgtaaaaattttttttgttgttataaactaagacacacacattgtgcctacaccgggtcaggagcatcaatatcactcttttcttcctccacatcttgtcctactggaaggttttcaggggcagtaacatgaatggagctgtcatctcctataataactgcttttttctggaatacttataattgtctagtattatgtacagtacatcattgtaagcattatgcttgtatatgactggcatcccaggtttgtttacaccagcattaccacagacatgagtaatgtgttacactacaagttatgagggctacaaagtcaataggaatttttcagctccattataatcatctgagaccagtatcatgtgtgcagtcgctgttgacctaaatgttatgtagcatgtgactagctgatgaatctttgattatggctgaatgttctcattcattgcaggaaaaaaatatcctccaaatcactaggtagtatgtaagtgaccaaaacttttttccattttatgttggagccaaatcattagtgttaggataaattacttctttatgtatgtgctctaaaatgaaaagttatttctgaatattaaagcatatgtattaagagtataaaaacaagatacagattttggtgtgaaatatatcttatgattcaagtcataatttaaatagaattgaagatgatgtgaaatcactgggctggaagtagcttataccttgattagtaagaggaagcccgggatcatcctgtgatggtaaacacttttatatgttttacttataactttgccaggaaatttcaacaaacttcatattaaaggacatgatttctgtatacttagtaatctgctatgcaaattgttgcattgaaatggcagacgaagcaagaagattgggagaaagtagctgtgggacttggagataggaaaataaacagccgggaaaactgcagaatgtgggaggaataattgcattcattgtattactatctgatttatattttatgaaataatttggtttcttaagatagtttttcaattttaagcacaccttttttaactggtgtggcagcttttctggtaagtggtagatttatgttagaagcatgtctatgcagcatattatagcattaaatatgtatacagatatctaactgaaataaaaagtgttttaataattaaaagtttaacatatgggcatatgtgacatatagtgatatagcatgtctctttagttttgttgtttttgttgttgatggctaaccacccatgcttgtcttaaaaattgataaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttga

SEQ ID NO: 8869 - DNA, 1372 bp, Homo sapiens
gtcttccccggctcgccaactcggctgctctgggggattcgtgcgcggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatattttt

SEQ ID NO: 8870 - DNA, 1555 bp, Homo sapiens
cgcaggagggcggtcttccccggctcgccaactcggctgctctgggggattcgtgcgcggtaagaagctgcgcggtagcgcggtgaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttga

SEQ ID NO: 8871 - DNA, 1248 bp, Homo sapiens
aactcggctgctctgggggattcgtgcgcggtaagaagctgcgcggtagcgcggtgaggtgaggttctcagccaccaaagctgcagggtctcgtcgttcgttccctctggcctggcggaacttgcgtgggaagctgggaggacagaaggcttagccgctgggtccctgagctggctggagcgcgggctgtctaggggcggcgacctcagctgttgggctccggctgctgggggctgtgcgtccagccgccctggaatccgcctgtgggtgggccgcttggctctcccacttcaccctcttgataacccagagcctcccccttcccacgtacgtaggggaaggataatctacttccttttgaacagcttcggtccccactatgacagtcgcataaacttcagcgaagagtgcgctggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttga

SEQ ID NO: 8872 - DNA, 2186 bp, Homo sapiens
cgccgttttcccggggagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaccaagccaagaggccctaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcg

SEQ ID NO: 8873 - DNA, 1658 bp, Homo sapiens
cgccgttttcccggggagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttgggagggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagcagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaatgggaaggaaagaaggccaagggaattcagattctga

SEQ ID NO: 8874 - DNA, 2356 bp, Homo sapiens
cgccgttttcccggggagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaccaagccaagagggcttgggggtgatgcaggcacagcagatggccgaggcaggacactgcagaggaagataatgaagagatctctaggcaggaaatccacagctcctcctgcacccagaatgggaaggaaagaaggccaagggaattcagattctgaccagccaggccctaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgactgggttggctggtctcta

SEQ ID NO: 8875 - DNA, 1716 bp, Homo sapiens
ggcgggacggggcggggccgcgggacgccaggaggcggaggcggagtggagttagattcatcccagtagaacgcctgcctctttagtgactacagacctcacttcccttctctggagttttggagtctattttcttcatggaattttgctaggaacaaaagaaaagtctaactccattaaatgccttaatggataaagaaaaattggatgttaagattgaatattgtaactatgcaatggattcctcagtggaaaacatgtatgtaaacaaagtgtgggttcaatgtgagaatgaaaattgtttgaaatggagattgttatcaagtgaggattcagccaaggttgatcatgatgaaccatggtactgcttcatgaacactgattcaagatataataactgctcaatttctgaagaagacttccctgaagagtctcagcttcatcagtgtggatttaagattgtctattcacagctccctcttggaagcctggttttggtaaaattacagaattggccaagttggccaggaatactttgccctgaccgttttaaagggaaatatgtaacttatgacccggatggaaatgttgaagagtatcacatagaattcctgggcgatccccattcaagatcatggataaaggcaacattcgttggacattatagtatcacattaaagccagaaaagtgtaagaataaaaagaagtggtataaaagtgcactacaagaagcatgtctactctatggatattctcatgagcaaagactggaaatgtgctgcctatcaaaactacaagataaatccgaaacacatgacaaagttgctgcactggtcaagaaaaggaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagttatctaaatgcagcccagaagctcctgcaggcagtctgtttgaaaaccactatgaagaggactatcttgtaattgatgggataaaattaaaagctggagaatgtattgaggatataactaataaatttaaagaaatagatgctttgatgtctgagttttagaacattatacatttttcaaattaattataaaaatattggcatctttatatttatccaaagttaaaactttaaaaatgtttagtgaaataggtataaattataccaaagtttatatttgcggtaactttctacttcatattttgagaatggccatgatttttagagccagtcaaatggtatttaagttagtgttaaaaatttagaattaaaaaaccctgatatttgtatttatatatttcttgtttgccttaatttttaaatggtttgtgaaatttgcctaacaaacatatgttttacaatgattgtttaggccctttgttcaaaaatggataacttaaaatggctggccaagctattataattctcagaggtaattcaaatctaataaacttagagaatgtatatttgcagtggaatcaaactattacaaaataaaaggaaataattttttaaataa

SEQ ID NO: 8876 - DNA, 816 bp, Homo sapiens
cgcggcgggacggggcggggccgcgggacgccaggaggcggaggcggagtggagttaggactttgtctatatctgagctgtgaagaatatttacagtaaaaagaaacaattcatcccagtagaacgcctgcctctttagtgactacagacctcacttcccttctctggagttttggagtctattttcttcatggaattttgctaggaacaaaagaaaagtctaactccacattgtcagtctggctgctataacaaattaccgtagactgggtggcttcaacaacaaacatgtatttctcacagttctggaggctaaaaagtccaagatcaaggtgacagcaggtcctatatctgatgggggactgcttcctggttttcagatggctatcttctcactgtatcctcacatggtgaagagtcgagattaaatgccttaatggataaagaaaaattggatgttaagattgaatattgtaactatgcaatggattcctcagtggaaaacatgtatgtaaacaaagtgtgggttcaatgtgagaatgaaaattgtttgaaatggagattgttatcaagtgaggattcagccaaggttgatcatgatgaaccatggtactgcttcatgaacactgattcaagatataataactgctcaatttctgaagaagacttccctgaagagtctcagcttcatcagtgtggatttaagattgtctattcacagctccctcttggaagcctggttttggtaaaattacagaattggccaagttggccaggaatactttgccctgaccgttttaaagggaaatatgtaac

SEQ ID NO: 8877 - DNA, 1659 bp, Homo sapiens
tcagattcatcccagtagaacgcctgcctctttagtgactacagacctcacttcccttctctggagttttggagtctattttcttcatggaattttgctaggaacaaaagaaaagtctaactccattaaatgccttaatggataaagaaaaattggatgttaagattgaatattgtaactatgcaatggattcctcagtggaaaacatgtatgtaaacaaagtgtgggttcaatgtgagaatgaaaattgtttgaaatggagattgttatcaagtgaggattcagccaaggttgatcatgatgaaccatggtactgcttcatgaacactgattcaagatataataactgctcaatttctgaagaagacttccctgaagagtctcagcttcatcagtgtggatttaagattgtctattcacagctccctcttggaagcctggttttggtaaaattacagaattggccaagttggccaggaatactttgccctgaccgttttaaagggaaatatgtaacttatgacccggatggaaatgttgaagagtatcacatagaattcctgggcgatccccattcaagatcatggataaaggcaacattcgttggacattatagtatcacattaaagccagaaaagtgtaagaataaaaagaagtggtataaaagtgcactacaagaagcatgtctactctatggatattctcatgagcaaagactggaaatgtgctgcctatcaaaactacaagataaatccgaaacacatgacaaagttgctgcactggtcaagaaaaggaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagttatctaaatgcagcccagaagctcctgcaggcagtctgtttgaaaaccactatgaagaggactatcttgtaattgatgggataaaattaaaagctggagaatgtattgaggatataactaataaatttaaagaaatagatgctttgatgtctgagttttagaacattatacatttttcaaattaattataaaaatattggcatctttatatttatccaaagttaaaactttaaaaatgtttagtgaaataggtataaattataccaaagtttatatttgcggtaactttctacttcatattttgagaatggccatgatttttagagccagtcaaatggtatttaagttagtgttaaaaatttagaattaaaaaaccctgatatttgtatttatatatttcttgtttgccttaatttttaaatggtttgtgaaatttgcctaacaaacatatgttttacaatgattgtttaggccctttgttcaaaaatggataacttaaaatggctggccaagctattataattctcagaggtaattcaaatctaataaacttagagaatgtatatttgcagtggaatcaaactattacaaaataaaaggaaataatttttt

SEQ ID NO: 8878 - DNA, 10282 bp, Homo sapiens
aaacctccatcagggttgcaacgccacgttgccttggatgcctgcgtgagtggagtcgcgactcggggcccgcgtcctgagagacgcgctcccgcgccgcttctcgcctccggaccgcaggggccgaagtcgcctatttctggctccgcgggcagcggggccgtggcgctcggacggtctgggattcgggcgccgccgcggaaccggaataagaagggagagcgcccggctcggtcctcggtctccaccgcggcccggaaggaatccgggcagcctccgcggagatacttgccagaactaatacagctgatgaaatacctgaccttttctgctccagcttgagtattcaaagacagtagccatctgacttcagttatttattcaagatgcagaaaagacaaggatattgcagttattgccgtgtgcagtataataacctggaacagcatttgttcagtgctcagcacaggagtttgaccagacagagtagacgtcaaatatgtaccagtagtttgatggaacgtttcttacaggatgtactgcagcaccacccatatcattgtcaagagagcagttcaacacaagatgagacacatgtgaatactgggtcatcgtctgaagtggtgcatttggatgatgctttttctgaagaagaggaagaggatgaggataaggttgaggatgaggatgctaccgaagagagaccatccgaggtttcagaacctattgaagagttacattccagacctcataaatctcaggaaggcacgcaggaggtttcagttcgaccatcagttattcaaaaactggagaagggacagcagcagcccttggagtttgttcataaaattggggccagtgtgagaaaatgtaacctagtagatattggtcaggctacaaataatagaagcaacttggtacgccccccagtgatttgtaatgctcctgctagttgtttacctgaaagctctaacgatagaccagttacagctaatacaactagtttaccaccagcagctcatttggattcagttagcaaatgtgacccaaacaaagttgagaaatatcttgaacagccagatggggcctctagaaatcctgtgccatcatcccatgtagaaactacttcattttcgtatcagaaacataaagaatcaaataggaaatctttacgcatgaattcagataagttggttttgtggaaagatgtaaaatctcagggtaaaactttatcagctggcttgaaattccatgaacgcatgggtactaagggctccttaagagttaaatctccttccaaattagcagtaaacccgaataaaactgacatgccttctaataaaggaatctttgaagatactattgcaaagaaccatgaggaattcttttctaacatggattgtacccaagaagaaaagcatttggtttttaacaagacagccttttgggaacagaagtgctcagtgagttctgaaatgaagtttgattgtatctctcttcagtcagcatctgatcagccccaagagactgcacaagacttaagtctttggaaggaggagcaaattgaccaagaagataactatgagtctagaggttcagaaatgagttttgattgcagttcctcttttcattcactgactgaccaatctaaagtgagtgccaaagaagtaaacctttccaaggaagtacgtactgatgtacagtataagaataataaatcttatgtttctaaaataagttctgattgtgatgacattcttcacttggttaccaaccaatcccaaatgattgttaaagaaataagtcttcagaatgcaaggcatattagcctggttgaccaaagctatgaatctagtagttctgaaacgaattttgattgtgatgcttcacctcagtccactagtgactacccccaacaatctgtaacagaagtaaaccttcctaaggaagtgcacattggtttggttgataagaactatggttccagtagctctgaagtaagtgctgattctgttttcccactgcagtcagtggttgacagacccccagtggctgtcacagaaacaaaacttcggaagaaggctcataccagcttggttgataactatggatcgagttgttctgaaacaagttttgattgtgatgtttctcttgagtcagtagttgatcatccccaactgactgtcaaaggaagaaacctgaaaggtagacaagtccacctaaaacataagaagcgtaaacccagtagtgctaaagcacatcttgattgtgatgtctcacttgggacagttgcagatgaatcccagagggctgttgaaaagataaatcttctgaaggagaagaatgctgaccttatggatatgaactgtgaatcccatggtcctgaaatgggttttcaggctgatgctcaattagctgaccagtctcaagtagccgaaatagagcgtcagaaagtggatgttgaccttgagaataagagtgttcagtctagccgttcttctctgagttctgattctccggcttctctttatcattcagctcatgatgagcctcaagaagctttggatgaagtaaatcttaaagagttaaatattgacatggaagttaggagctatgattgctccagctctgagttgacttttgattctgacccgcctcttctgtcagttactgagcagtctcatctggatgctgaaggaaaagaacggcacattgacctggaagatgagagctgtgagtcagatagttctgaaataacttttgattctgatattcctctttattcagtaattgaccaacctgaagtagctgtttatgaggaagaaactgttgatctggaaagtaaaagtaatgaatcttgtgtctctgaaataacttttgattctgatattcctcttcattcaggaaatgatcaccctgaagtagctgttaaagaagtaattcagaaagaagagtacattcacttagaaaggaagaatgatgaacccagtggttctgaaataagttcggattcccatgcccctcttcattcagtgactaattctcccgaagtagctgttaaaaagctaaatcctcaaaaagaagagcaggtacacttagaaaataaggaaaatgaacctattgattctgaagtaagtttggattataatatcatttttcattcagtgactggacgttctgaagatcccattaaagaaataagccttcacacaaaagagcacatgtacttagaaaataagagtgtttttgaaacaagtttggattctgatgtccctcttcaggcagcgactcacaaacctgaagtaattgtcaaagaaacatggcttcaaagagaaaagcacgctgaattccaaggtagaagtactgaattcagtggttcaaaaacaagtttagattctggtgtccctcattattcagtaactgaacctcaagtagctgttaacaaaataaacagaaagaagcaatatgttctagaaaacaagaatgataaatgtagtggttctgaaataattttggattctaatgttccacctcagtcaatgactgaccaacctcaactagcttttttgaaggaaaaacatgttaatctgaaggacaaaaacagtaaatcaggtgattctaaaataacttttgattctgaacaacttcaggaagcggttaaaaaaatagaccaatggaaggaagaggttattggcctgaaaaataagattaatgaacctagtacttataaattaatacatcatcctgatgtttctgtccaatctgtggctgatcaacccaaagtagctattaaacatgtgaaccttgggaatgaaaaccatatgtacttggaagttaagaacagccaatatagttgttcagaaatgaatttggattctggtttcttgggtcagtcaatagtcaatcgacctcaaataactattttggagcaggagcacattgaactagaaggtaagcacaatcaatgttgtggttctgaagtaagttttgattctgatgaccctcttcagtcagtggctgaccggctgagagaaaccgttaaagaaataagcctttggaaggatgaagaagttgacacggaagataggagaaatgaagctaagggttttgaaattatgtatgattctgatgttcttcagccagtggctggccaacctgaagaagtagttaaggaggtcagtctttggaaagagcatgttgacttggaaaataagattgtcaaacctacagattccagaataaattttgattctcatgaaccccttcagtccgtaactaataaaattccaggggcgaataaagaaataaatcttttgagggaggaacatgtttgtctggatgataagggctatgtgcccagtgattctgaaataatttatgtttcaaatatccctcttcagtcagtgataaaacaaccacacattttggaagaggagcatgccagtctggaagataagagcagtaattcttatagtcctgaagaaagttctgattccaatgactcttttcaggcagcagcagatgagcttcaaaaacctgtcaaagaaataaatctttggaaggaagaccatatttacctggaagataagagctataaattaggtgattttgatgtaagttatgcttctcatattcctgttcagtttgtgactgatcaatcttctgtacctgtcaaagaaataaacttgcaaaagaaggatcataatgatctagaaaataagaactgtgaagtctgtggttctgaaataaaatgtcattcttgtgttcatcttcagtcagaagttgaccaacctcaagtgtcttacaaagaggcagaccttcagaaggaagagcatgttgtcatggaagaaaagaccgatcaacctagtgattcagaaatgatgtatgattctgatgttccttttcaaatagtagttaaccaatttccaggatcagtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggttctgaaatgaattttaatgttgatgcctctgatcagtccatgacttacgagtcacaaggacctgatgagaaaatggtgaaatatattgattcagaagataagagctgtggatataatggttctaaaggaaaatttaatttggaagacacttctcatcgaacgactcaccgactgcagaaagctcacaaagaagccagtcttcggaaggatccaagaaatgctggcctaaaaggtaagagctgtcagtctagtgcttctgcagtggattttggtgcctcttccaagtcagcgctccatcgaagggctgataaaaaaaaacgttcgaagctaaaacatagagatctagaagtgagctgtgaaccggatggttttgagatgaattttcagtgtgctccccctcttccatctgatactgatcagcctcaagaaactgttaagaaaagacacccttgtaagaaggtatcttctgacttgaaagaaaagaaccatgattcccagtcaagctctgttctcaaggttgattctgtaaggaacctgaaaaaagcaaaggatgtcatagaggataatcctgatgaaccagttcttgaagccttgcctcatgtacctccttcatttgtggggaaaacatggtctcagataatgagagaagatgacataaaaattaatgctctggtgaaggagtttagggaaggtcgtttccactgttactttgatgatgactgtgagaccaaaaaagtttcttcgaaggggaaaaaaaaggttacctgggctgacttgcaaggtaaggaggacactgcaccaactcaagctgtgtcagagagtgatgatattgtctgtggtatttcagatattgatgacttgtcagtggccttagataaaccatgccatcgtcatcctccagcagagaggcctcctaagcaaaaggggcgtgtggcttctcaatgccagacagcgaaaatcagccatagtactcagaccagttgtaagaattacccagtgatgaaaagaaaaataattagacaagaggaagacccaccaaaaagtaagtgttcacgtttacaggatgacagaaaaaccaaaaagaaagtcaaaattgggacagttgaatttcctgcatcatgtactaaagttttgaagcctatgcaacccaaagccttagtctgtgttctttcttctttaaatattaaactgaaagagggtgaaggccttcctttccctaaaatgaggcaccatagttgggataatgatattcggtttatatgcaaatataaacggaatatctttgattattatgagcccttgattaagcaaattgtaattagtcctcccctgagtgtaatagtaccagagtttgagaggcgtaactgggttaaaattcattttaataggagcaaccaaaactccagtgcaggagataatgatgctgatggacaaggctctgcttcagcgcctttaatggcagtgccggcaagatatggatttaattcacatcagggaaccagtgactcttctctgtttctggaagaatcaaaggttctgcatgctcgtgagcttccaaagaaaagaaatttccagctaacatttttaaatcatgatgttgtcaaaatctctccaaaatcagttagaaataagcttttggaaagtcaaagtaaaaagaaaattcatggaaagagggtgacaactagtagtaataagctaggttttcccaaaaaggtttataaaccaattattctccagcaaaaacccagaaaagcttcagagaaacagtcaatttggattcggaccaaaccaagtgatatcattagaaagtatatttcgaaatactctgtctttttacgtcatagatatcagtccaggagcgcttttcttggaaggtatctgaagaagaaaaaatctgttgtcagtaggctaaagaaggcgaagagaacagctaaagtgcttttgaactcttcagttccaccagctggtgccgaagagctgtcaagcgctatggcaaatcctcctccaaagcgacctgtgcgggcttcttgccgcgttgcaagaaggaggaagaagactgatgaaagctaccatggccgacagaaaggtccttctacacctgtgagagcatatgatctgagaagctcatcttgtttacaacaacgtgagagaatgatgactcggctagcaaacaaactgagaggtaatgaggtaaaatagaagttggttttgtgttcaggctagttgaggattcagtacttcagttgaaatatatttggtactttgtgcacacagctttcccagctttggtgagaaaactaatcttgaactattttgctataaatattatttttcagaatttttatattcatttaaaattagtgtttagagtcctttcattttaagattcagaaacagcctttgtccaacattttctgtagaagaacttcatcttaatttatgtcacaaaataatttagcaccgtatatagaattttgttcctcaaatcatatccctcttattttttatgattatctctctcatgccagcaaatttaacattgtgagaatgaatatagcaaacttattaaaaagaaggaattataatgaattatgtcaacttttgaatggggttgacttaaatgaatacaaacaaaatataagttttctttctttttaaagcattccagaaaatgagattccataatctttaatacagtttttaaaaactggtgattttttttatgcatagcacaaactcctcctgcttcatttaaattggatctgcaagtctctaacttttatcatttggacacatgcacacatacagtctctaggttttttgggttagccttattagatcttaaaggggaaaataattttgcccatgtgtttaggcattcccccccttttttttaaccacctttactctcttctacatgaagagttggtggcttaatatgaaaatccaggttattttgtggccttatcccctaaaaatattttaggcattaccatatcagtttttatttttatgtttatttattattattattttttgagacagagtctcactgtcttgcccaggctggagtgcagtggcctgaacttagctcaccgcaacctccacctcccgggttcaagcaattctcctgcctaagcctctcgagtagctgggactacaggcgtgcgccaccatgcccggctaatttttgtatttttagtagagttgggggtttcactatgttggccaggctggtctcaaactcctgaccttgtggtccacccgcctcagcctcccaaagtgctgggattacagtcatgagccaccatgcccagcctaccatatcagtttttaataacttgaactgaaattattggcttggtaatatttgggcaggccattaattctcattagaaaattacttaatatttcaaaaaattgaataaaactggtaatctttgtggaggcccattttgcaagtggaaacctgtatttatacattagtttgtctttaactatttgttaacagattttaacagttcaaatgaaagatgttaacgagatgcagtttgagtctgggatactcagaatagatccagaacctttattcagggacactggttgagttggtacagatgcattcagttgtcattcattcgtgttaagccaagatcctggatcttctatcattaatgttaagaggaaacatgaattacaactatattgtatgactgccatattttattgaaactaaggtcaatgttgaaccatatcttgatttcagaatttaaaatgtgttaccttagaaataatgaaatatagtgtaacagttggtttctaaatgtggttttatttcaggggccattatttaacctgtgtgtatgctatgatggagttcttttgtgatttctttacttctaaatttaaatagtaattatgtttaaaaacaaatgtttttgtctttagttgcaaagcagcatatatctcatttccttcaaccttgcctcctcatacacaaatatattttcatttcttaaaagatcactgggccagtagttcaaaataatcctccaattttaatttaggaacaaagctttgtcctactgactaggaagtaaacaaacagctgatatataagatatttgtgggtattggtgtcttttttccctatggaatagacacatagttcccttaaatattattaatagacattctacagtctttcagtgtaagtttaaaagcaagagatcaaatgaaaatgtgtactatgtacctatgatgtgtcatatcgtgattacatcatgcagagagaacagttcctgtaattcaagtaattaaaatttcaagttgtaaaaatgttaccattttcacattggaagcccttctaagtaccattttcattgggggcagggagaaggtttatatttaaattttatattaccagacataaaagtacagtgcagtactgatgattttgtttaaagtttttgaaatgttttgtttactaagttcttgtaatcattattttagacaagcttgaaaacttgaaattgttgaaacttataatttaaattaaattggaaattactttcagaatttggtagtatacaagatgtgcccctttgtctaaataaatgttggcttaatttgcagaatagataaaacaattgatgtttttgtgtgttcaagaatgcattaaattcttttaatagtaaaaagtcaaattacgaccataatgagtattttaatcttgttcttgttcagtattttgcgtagatttttattgtaattgtcctgagttctacagtatgtgaacaatatcgtgtgaagtgtgtttttgcatttgtgcatttaaattatttatgtaactagggctgtgagtaacactttttttttttttttttggttaaagaaaagctatatttaaatattcaaataattatatatttccatgtaaaactaatgtgaagactaatgtattttttatattgcagtgtaaaagctaaacttgtttttgatgttatcaagataaaatttattaaaccttg

SEQ ID NO: 8879 - DNA, 1324 bp, Homo sapiens
atggacacccgctccgggagccagtgttccgtcaccccagaagccatacgcaacaatgaagagctggtcttgccgccccgcatctccagagtgaacggctggtcgttacccctgcactacttccgggtggtgacttgggctgtcttcgttggcctttccttggccaccttcaggatcttcattcccctcctgcctcactcgtggaaatacatcgcctatgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccagggtgctccgcacggaccccaggtatgaagatgtcaagaatatgaacacgtggctgctgttcctccccctgttcccggtgcaggtgcagactctgatagtcgtgatcatcaggatgctcgtgctcctgctggaccttcttggcttggtgcagctgggccagctgctcatcttccacatctacctgaaggccaagaagatgaccacctttgagtatctcattaatacccgcaaagaagagagttcaaaacatcaagcagtgaggaaagatccatacgtgcaaatggacaaaggatttctccagcaaggagctggcgccctgggctcatctgcacagggagtcaaggccaagagctccctgctgatttacaaatgcccatgtcacttctgcacttcagtaaaccaggacggggattcgaaggcacaggaagcagatgatgccccgagtacatctacacttgggctgcaacaagaaacaacagagcccatgaaaactgacagtgctgaaagtgaagactgagattcgggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcat

SEQ ID NO: 8880 - DNA, 2030 bp, Homo sapiens
tctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 8881 - DNA, 1784 bp, Homo sapiens
ggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacagcctgcccttctccaggtcgctggagttagattaccacacttcctcctgcttccggggcaccatggtgaaggctgactgtcctgtccctatcacagacctgccagattcctctggtaaactgcagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 8882 - DNA, 2260 bp, Homo sapiens
gttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattggg

SEQ ID NO: 8883 - DNA, 1225 bp, Homo sapiens
gagagtgcgggcggaagacggggagagcgagaggctggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaa

SEQ ID NO: 8884 - DNA, 2797 bp, Homo sapiens
gctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaagtggacaaaggccagaggaaataccgatggacctaacggtagtgaagcaggaaattatagactggccaggtacagaaggcaggttggctggccagtgggtagaacaggaggtggaggataggcctgaggtgaaggatgagaacgcaggcgtattggaggtgaagcaggagacggatagtagtttagtggtaaaagaagcgaaggtgggtgaaccagaggtaaaggaagagaaggtaaaggaagaggtaatggactggtcagaagtgaaggaagagaaggataacttggagataaaacaggaggagaagtttgttggtcaatgcataaaagaggaattgatgcatggagagtgtgtaaaagaagagaaggatttcctgaagaaagaaatcgtggatgatacaaaggtgaaagaagagcctccgataaatcacccggtgggctgcaagcggaaactggccatgtcaaggtgtgagacttgtggtacagaagaagcaaagtacagatgtccacgttgtatgcgatattcctgcagtttgccctgtgtaaagaaacacaaagcagaactgacatgtaatggagttcgagataaaactgcatacatttcaatacaacagtttactgaaatgaatctcctaagtgattatcgatttttggaagatgtggcaagaacagcggaccatatttctagagatgcttttttgaagagaccaataagcaataaatatatgtactttatgaaaaatcgtgcccggaggcaaggtattaacttaaaacttctacccaatggattcaccaagaggaaggagaattcaaccttttttgataagaaaaaacaacagttttgttggcatgtgaagctccagtttcctcaaagtcaagctgagtacatagaaaaaagagtaccagatgataaaactattaatgaaatcctaaaaccttacattgatcctgaaaagtctgatcctgtaattcgtcaaaggttgaaagcctacattcgctctcagactggggttcagattttaatgaagattgaatatatgcagcaaaatttagtaagatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 8885 - DNA, 6080 bp, Homo sapiens
agtcgcgtcaagcaggctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaagtggacaaaggccagaggaaataccgatggacctaacggtagtgaagcaggagacggatagtagtttagtggtaaaagaagcgaaggtgggtgaaccagaggtaaaggaagagaaggtaaaggaagaggtaatggactggtcagaagtgaaggaagagaaggataacttggagataaaacaggaggagaagtttgttggtcaatgcataaaagaggaattgatgcatggagagtgtgtaaaagaagagaaggatttcctgaagaaagaaatcgtggatgatacaaaggtgaaagaagagcctccgataaatcacccggtgggctgcaagcggaaactggccatgtcaaggtgtgagacttgtggtacagaagaagcaaagtacagatgtccacgttgtatgcgatattcctgcagtttgccctgtgtaaagaaacacaaagcagaactgacatgtaatggagttcgagataaaactgcatacatttcaatacaacagtttactgaaatgaatctcctaagtgattatcgatttttggaagatgtggcaagaacagcggaccatatttctagagatgcttttttgaagagaccaataagcaataaatatatgtactttatgaaaaatcgtgcccggaggcaaggtattaacttaaaacttctacccaatggattcaccaagaggaaggagaattcaaccttttttgataagaaaaaacaacagttttgttggcatgtgaagctccagtttcctcaaagtcaagctgagtacatagaaaaaagagtaccagatgataaaactattaatgaaatcctaaaaccttacattgatcctgaaaagtctgatcctgtaattcgtcaaaggttgaaagcctacattcgctctcagactggggttcagattttaatgaagattgaatatatgcagcaaaatttagtaagatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatctatattgtatgtgtgtacttaatggttaaaaagcaatgataaaactggacattaatgaaattgatttttagttacagttggaataagttttttaccaaaaagaaaccagagacgttagttaaggagacttaaaaagatctgaaatatgaaaagagaatgagaagatgagcagaagataaatttgtgggacacaagtataacttggggtagaaactggagaagagaatcgaaaaacaataatgccagaaggacccttggtatgaaagtactaatggaatgtgattcatagaaagttcatagaaagtgagtccttgcaacttgagaaacatacatacatatatatttataatctctaaagcaacatcaggaatcttctaatatatgataaagaatttgtgtagaattacgttgttcacagtattattggagagacaaataagatttcaaggaattcatttataatcaaaagtgaaatgtgtcttcttgaaaccagcaagaaatagatgaattgagtgaaacgtgttgttattaggagaagtgggataacgtatacaaaaagaacttgcgatctgaatatgatctgaatatgagggtggataggaattttttgacagtgaaatctgttatgatgtagtctcatttccaagaaaagtcttgagttccatccccccttctgaatttaaattgaaacctggacagaaaacaaactatcctgtagtttccactgctcaggaggaaaaaaagaaatctatattatctaatgcatctttgccatctttattttctagaattctattagacttttcaattataggctattaggaaagaatataactcttagaattcccctaaatataattatcaactcatttgattaatatgcatattttttcccgtaagatttacaatacacgtgtgttttagtgaattaccaatggcttggagagaatgaaattggaataactaactgaaaaccctagatgtttgtagcattgagacccaatatctttttggaggccctctccatgttagcttattgtcaaattctggtgtgtaaacaaactccttgacccatgttaagttcagcatcctgcattttgttcatgaatcacattttaaaaggagaaaagctccacctggttttctttatttttttaaacagtgatttcaaagagaagataggcctttcataattgctaattatacatataggattaatagtcataaattatagtaaataaaacttgtacctattccttttataaatatgaattggctaggcacagtggctcacagctgtaatcccagcactttgggaggctgaggcgggcagatcacaaggtcaggtgtttgagactagcctggccaacatggcaaaaccctgtgtctactaaaaatacaaaaattagccaggcgtggtggcaggcacctgtaattccagctactcaggaagctggggcacgagaatcacttgaaccctggtggcagagtttgcagtgagctgagattgttccactgcattcctgggcactgcctgggtgacagaatgagactctgcctcaaaaaaaaaaaaagttattaaaaatagatatttaagattccaaaatgtagttgatccagtttgtttccctgtagcaagtagtgggatttgggtttcatgacatataattaaaatgttaatcacataactataatgccaacaattttctttatacatttttgtttaattatgttgacatatactttgtgttgtaccttatttcatgttactaaattttacataaagatgctggtctatttttatttaatcatatactgttatggtttgaatatagtttgttcctaccaaaactcatgttgaaattagattccccatgtgctagtgttgggaggcagagcctaatggaaggtgtttgggtcatgggggcagatagatcccacatgaataaactaatgccctcctactggggtgagtgagttctcattcttgctgtcgtgggaatggattagttctcacaagcaagggttactaaagagtctggctttcttgattttctcctttttgcctcctgccttcccatgtgatctctttgcacatacctactcccctttcactttgtaccaagagtggaagcaacatgagaccctcaccagatacagctgcccaatcttgagccttccagccaccagaatcatgagccaaataaaactctttttaaaaataagttacccagtcttagatattctattatagcgacacaaaatggactaagctgtactctgttgcattaaaatgtgttgtttatatgcaagtgacaaaaactcaaaatagtgtcagcatgaagggcagttcattggcttatatacagggaagtccaggcaatgactgggtcctgggtccaaacgtcaaaagcagtcatcttgccatcctacacacttggctctgattattttcttctttatggattggttttcttttcagattttccctttggggatattctgtatgggatgaggaacagtgaggtgagaggatggtggataacagcaattgacattttcagcttaccttagcataacaaggctgaaagcttttataaagcaagctatgtaaaattttggagaagtacttttattttgcccagattggatcacattccgttcctgagctaatcaagagaggaattcacccaaaggagggggaaatttttagaagaaagccagaatgtagggagcaggtgaggaaaggtagttactgggaatacgaaagtaacacattcattgcaccctgtttgaatttgagtagcaagaagtttctgatttgtactaacagaaggagtaaagttcagatttaatctgcaagtcttgattgtttttaactagagattttaatctcttcttcttattattgctgctttgagttgccattataggtttttggattttttttttaatgccatccatttttatttgacatcatgttgttgctagtttgagcagatgcacatagcatatgtttccattaccaatttggaaatttttcccagtggcatcagcatttgagagatactgattttgaaattagagtactaggggaaaatgcttcaaaaatgaagactacttaaataaaaattggctttaaataaacctttggggatctgtacttgactaaaaagtattttctttaaactttggtctttgaaaactaaagtgtgtgtgcatgtgttcattaaaatgacctataacatgaacattttccatactggagtgtgatgtactgtactcattttgaactttagaaccaaatgcatcctttagcatttgatgagctgctatataattctatttccagttttattttcttgccaaataaagtaccaaagctca

SEQ ID NO: 8886 - DNA, 6994 bp, Homo sapiens
agtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttga

SEQ ID NO: 8887 - DNA, 6726 bp, Homo sapiens
agtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttg

SEQ ID NO: 8888 - DNA, 466 bp, Homo sapiens
gagcggggcccaacatggcggagagagaggtggagtccggcccccgaaagagggaacatcgtgatcaattagccactgccaaagatccctgctggccaaaacattctgattaccgtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaatt

SEQ ID NO: 8889 - DNA, 6003 bp, Homo sapiens
acctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgatgggtgagttcttcttctttacgtcttaaaagaatttgaaatctctttttctgattgaccttattggtatgacccagcaattagtaaaattacaaagaaagagagcagtttccg

SEQ ID NO: 8890 - DNA, 1775 bp, Homo sapiens
actgtacgggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggggtggtacatcagaaggctgactgggacagcatccatgagaaaatatgtcagctcttgattccactgcgcacttccatgcccttctacaattcagaggaagaacggcagcatggcctgcagcagctgcagcagcggcagaagtatttgattgaattctgctacaccatagcccagaaatacctctttgaagggaaacacgaagatgctgtaccagcagctttgcagtcccttcgcttccgtgtgaagctgtatggcctgagctccgtagagcttgtgcctgcttacctgctgttggccgaggccagccttggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgttttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccagaagtcttccaacgatgcatgtttcatacacttttgctaaaggaggggtaaaggagggggtagggaataaagctatattggaacaaa

SEQ ID NO: 8891 - DNA, 1597 bp, Homo sapiens
actgtacgggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggggtggtacatcagaaggctgactgggacagcatccatgagaaaatatgtcagctcttgattccactgcgcacttccatgcccttctacaattcagaggaagaacggcagcatggcctgcagcagctgcagcagcggcaggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgttttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccagaagtcttccaacgatgcatgtttcatacacttttgctaaaggaggggtaaaggagggggtagggaataaagctatattgg

SEQ ID NO: 8892 - DNA, 2421 bp, Homo sapiens
atttcacttggaggaaagagagaaggaaggaagctgaggacttagcagggtatcactggacaggccatggctccacggtcccggcgacgaaggcacaagaaacctccctcatcagtggctcccatcatcatggccccaaccacaattgtgacccctgtgcctctgaccccctcaaaacctggccctagcattgacacacttggcttcttctccttggatgataatgttcctggcctatcgcagctgatccttcaaaagctgaacatgaaaagctatgaagaatataagttggtggtagatgggggtacccccgtatcaggctttggatttcgatgtcctcaagaaatgttccagaggatggaagacacatttcgattctgtgctcactgtagagcactccctagtgggctttcagactccaaggttctccggcactgtaagaggtgcagaaatgtctattactgtggtccagagtgccagaagtcagactggcccgcacacaggagggtttgtcaagagcttcgtcttgtggctgtggaccgtctcatggaatggcttctggtcacaggtgattttgttctaccctcaggaccttggccatggccacctgaagctgtacaggactgggactcctggttttctatgaaggggttacacctagatgctacattggatgctgtgctagttagtcatgctgtgaccaccttatgggccagtgtaggacggccaaggccagacccggatgtcctgcagggatctttgaagcggctgctgacagatgtcctgtcacggcccttgactctaggcctaggacttagggccttggggatagatgttaggaggactgggggaagcacagtgcatgtggttggtgcttcccatgtggagacatttcttactcgcccaggggactatgatgagcttggttacatgtttcctgggcaccttggactccgtgtggtcatggtgggtgtagatgtagctactggcttttcacagagcacctcaacttcacccctggaacctggcacaattcagcttagtgcccacaggggcctctaccatgacttctgggaggagcaagtagagaccgggcagacacaccatccagatttggtggcggcattccatccaggttttcattcctccccagacttgatggaggcttggctgcccaccctgctgctacttcgtgactataagattcctacattgattactgtttacagccatcaggagttggtatcctctttgcagattctggtggaactggatacacacatcactgcctttgggtctaatcctttcatgtccctcaaacctgaacaggtctattccagtcccaacaagcagccagtatactgcagtgcatactatatcatgtttcttggaagctcctgtcagctggataataggcaattagaagagaaagtggacggcgggatttaaatagatcataactggacatctggaaaacggggagtttgtgatgaaattaccctgctaatgccaggttcttgcaaactttgaaaaacattatattctaaacctcatttactgtttgggtaaaaattctaagctgaatgagagtttctgtataacataactggtttctttctttttttgagatggagtcttgctctgttgcccaggctggagtgcagcggcatgatctcgactcactgcagcctccgcctcctgggttcaagtggttctcctgcctcagcctccctagtagctgggattacaggtgcacaccaccacacctggctaatttttgtatttttagcagacagggtttcaccatgttggccaggctcgtatcaaacccttgaccccaggtgatctgcctgcctcagcctcccaaagttctgggattacaggcatgagccaccatgcccagccaatgtaactggtttctaagagtttagccacagtagcttctagagataggaaattagatttagtgggtgggaagaggccctgatgctggtctttccagagcttatagttgctaacacttttctttgtaaagaagtttaccttttgactggaaccagatggcactgagaaaaagaatgagaaccaccttattcttctgaaaaagactttcttctcatccagtaatttgggctaaaaaatggaaagatgttgatgacttgaagtgatgcaagaatggacaagtcagggaagtcattgggaacatggatgaggttgtaagcattggtacagtgtcctgtttcctgacttttttgagagaaatgtctacttttcctgttttctcttggggacttttgaccctagagtagccctggtgttatattttagatatcccaagctatatcagactttacctgaatatactggagttacttattatcccccattctataccccaataaactcagtttggggcttctt

SEQ ID NO: 8893 - DNA, 1510 bp, Homo sapiens
gccatggctccacggtcccggcgacgaaggcacaagaaacctccctcatcagtggctcccatcatcatggccccaaccacaattgtgacccctgtgcctctgaccccctcaaaacctggccctagcattgacacacttggcttcttctccttggatgataatgttcctggcctatcgcagctgatccttcaaaagctgaacatgaaaagctatgaagaatataagttggtggtagatgggggtacccccgtatcaggctttggatttcgatgtcctcaagaaatgttccagaggatggaagacacatttcgattctgtgctcactgtagagcactccctagtgggctttcagactccaaggttctccggcactgtaagaggtgcagaaatgtctattactgtggtccagagtgccagaagtcagactggcccgcacacaggagggtttgtcaagagcttcgtcttgtggctgtggaccgtctcatggaatggcttctggtcacaggtgattttgttctaccctcaggaccttggccatggccacctgaagctgtacaggactgggactcctggttttctatgaaggggttacacctagatgctacattggatgctgtgctagttagtcatgctgtgaccaccttatgggccagtgtaggacggccaaggccagacccggatgtcctgcagggatctttgaagcggctgctgacagatgtcctgtcacggcccttgactctaggcctaggacttagggccttggggatagatgttaggaggactgggggaagcacagtgcatgtggttggtgcttcccatgtggagacatttcttactcgcccaggggactatgatgagcttggttacatgtttcctgggcaccttggactccgtgtggtcatggtgggtgtagatgtagctactggcttttcacagagcacctcaacttcacccctggaacctggcacaattcagcttagtgcccacaggggcctctaccatgacttctgggaggagcaagtagagaccgggcagacacaccatccagatttggtggcggcattccatccaggttttcattcctccccagacttgatggaggcttggctgcccaccctgctgctacttcgtgactataagattcctacattgattactgtttacagccatcaggagttggtatcctctttgcagattctggtggaactggatacacacatcactgcctttgggtctaatcctttcatgtccctcaaacctgaacaggtctattccagtcccaacaagcagccagtatactgcagtgcatactatatcatgtttcttggaagctcctgtcagctggataataggcaattagaagagaaagtggacggcgggatttaaatagatcataactggacatctggaaaacggggagtttgtgatgaaattaccctgctaatgccaggttcttgcaaactttgaaaaacattatattctaaacctcatttactgtttgggtaaaaat

SEQ ID NO: 8894 - DNA, 4046 bp, Homo sapiens
ccaatggtaaaactaggaggacagccattttgcccacttgtaaaagagctaccttttcccacgagttggagcctgaggtgcggagtttcgtgagtttttactgactcgaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggctgatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccaggtaatgaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagtaaagtagaaaaatatatgaatgaatgacaaatggtttacatgtggaagactttaatacagaagttttccatgtttgtttaatatatcgagagtaaaaattttcagaacaaaaatcaagaattcaaattctcttctactaattacttttagtattaaatacattttgaaagtacttaacagaaactaagatacaatactgaatatttctgtggtctttttgatttgattcagactcgcaattatgtttcagcaatgttttgtaaagctctttacccctaatatgcctaatcactgtattgtgcatagattgtgtttaaaaaatgtactctcaattacctaaaaatgcttctggattagtattgttctggactgtcataggtatgagtggaacattgcaaaaccttatgggaaatttcagacgcaaatcattatttgggaattctgggccaagcatgaccagcctgcttaggattcaagagagactgtccactaaatacctccagaatgagctaggggcacacattttgggtgttgcttttcttgctttatttcttagctagtcatctttatcaaaaatatccttttcaaaatgaggtacctatggtgtttgtggacaatttgggggttctgtgtaaagtaattgttaaaactattaaataactgaaaacataaaatgtaaaatgccacttaa

SEQ ID NO: 8895 - DNA, 3519 bp, Homo sapiens
ccaatggtaaaactaggaggacagccattttgcccacttgtaaaagagctaccttttcccacgagttggagcctgaggtgcggagtttcgtgagtttttactgactcgaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggctgatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccagaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagaaactgcatgaatcacacaaggtaacaggtgccgagcaaggtctgcaggtttctggattgccagatagtgcagcacctgaaggaggtgcagcgcacacaaatgatcagcgcaggtgtcaaaggatgaagcagccacttacagaagtgcaaatcctcagccactcatcttaa

SEQ ID NO: 8896 - DNA, 2777 bp, Homo sapiens
ttgtaaaagagctaccttttcccacgagttggagcctgaggtgcggagtttcgtgagtttttactgactcgagatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccaggacctgtatgacaaggtggcctgggggaaaagaactcttgtctcaggactttttatggagtgcttctgttttgtcccttaggattaagtttgaagggattaacatttactgcagcaagtcatgttgtatttgctgagttgtactgggaccctggacatataaaacaagcagatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccaggtaatgaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccatt

SEQ ID NO: 8897 - DNA, 6820 bp, Homo sapiens
cccttttcgcaaccctaacgggagagaagtgatggaagaagggtagccggaagagtttcctcaaaataccataggggttttaaattattagtacgtatttaaactcatctactttcacgttgtcccgttgaacgtcacttccgcttaggggcggacacgtcccaaacctgtggcgggagttggagattctgcggcgaatacgccaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggctgatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccagaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagtaaagtagaaaaatatatgaatgaatgacaaatggtttacatgtggaagactttaatacagaagttttccatgtttgtttaatatatcgagagtaaaaattttcagaacaaaaatcaagaattcaaattctcttctactaattacttttagtattaaatacattttgaaagtacttaacagaaactaagatacaatactgaatatttctgtggtctttttgatttgattcagactcgcaattatgtttcagcaatgttttgtaaagctctttacccctaatatgcctaatcactgtattgtgcatagattgtgtttaaaaaatgtactctcaattacctaaaaatgcttctggattagtattgttctggactgtcataggtatgagtggaacattgcaaaaccttatgggaaatttcagacgcaaatcattatttgggaattctgggccaagcatgaccagcctgcttaggattcaagagagactgtccactaaatacctccagaatgagctaggggcacacattttgggtgttgcttttcttgctttatttcttagctagtcatctttatcaaaaatatccttttcaaaatgaggtacctatggtgtttgtggacaatttgggggttctgtgtaaagtaattgttaaaactattaaataactgaaaacataaaatgtaaaatgccacttaagcttgattttttagatctttttttaaaaaatgaataaaactaggcttactgttggctgggcgcggtggctcacgcatgtaatcccagcactttgggaggccaaagcgggtggatcatgaggtcaggagatagatcgagaccatcctggctaatacggtgaaaccccatctctactaaaaatacaaaaaattagccgggcatggtgttgtgcacgtgtaatctcagatactcgggaggctgaggcaggagaattgcttgaacccgggaagcagaggttgcagtgagccgagatcacgccattgaactccagcctgggcgacagagcgagactccgtctcaaacaaacaaacaaacaaaaaaaaaaactaagcgtactatcaaaatacactttgtcttctggttctcattttctgtttttaaaaccctgtgttattaaaggtatgtttctggtacttattttaaaaagagtgatgatgacaaaacactttataataaggcataatcagatggttatatgcatttaaatatacaataataacattaaaatgtaattgacataaaataagagtgacgatgaaacaaacccagggcctagtcctgcaatatgtcagaatcatgagggcaaagagtcagaactatacaaaatacaggaccgaggaagaattacattcccaaaagggagctgtttgtaaatactattaggacatatacctctttagtttgagcattttcccacgttaattaatagctagtgttttacaacataaaggacttgtttttagaaagattatacaatcaaagattatacaaccacagttgttcctcagtttctatttcattgtatgagatcaagtcatgttggttattttataaatgaagttgggctttctttggcctcctttctgcttagttggtcaggtgctctttgcagttttctgcctcatttccaaggtaacctaggatttgtcacggttgagagccaagaagcaggcacgctgcctttcctccagcatggggttttgcaagcgaggtctaagtaggtcaaatttgaggggaacttgctcttcagatcacactaaggtgataattctaaggagaaagttctcagatgtaagaactgtgtgatggtttgaggtgaaacaatccatgaagataggctcagtctataccaggtttcagaattctgactaattaaaaatgccgtaaggagcattgagcatttgctgtacaggacactgactggcccgtccccatcccttcctgacatgtctcagagctttgtgtcctgccttcccctaatttggtctgcattacttgtggggcacattgagatgaagggttctgagacagaaaataaagatagagattgatctaataaccgagaccgaaagggcatcttgaggactgttctttcctcctcacaatctgaaacagaagctccccactatgtattgcaaatgggaggttatgacagagggacacagaaagtgtcagagcaagtggcagatcctgagtgcagaaggaagtgcagatgccccaggaagaagacagctgctgccactcaggagatggagatggagtgaaaacacaggtgggtacaatgagtgtaaaaggataggcctggctctgaaaagactcagagaagctgcaagatacagtttaggctaagaaaacaacaacaaaaaagggctctggccaggtatgatggcacttgcttgtagtcctagctacacaggaggctgaggtaggagggtcacttaagcccaggggttcatgaccagcctgggtaacacagcaaggccccatctcaaaaaagaaaaaaggctctgggtccagggaacagagctgggaagtggtaggtgacgaaggaactcgcttacgatagggaaccatatgaaaatatgcctgtgggtaggggtagggtggggaggacttccggagcatggtgggctcacacactcaaaccttgcacagccagcatcaggctggcctgccttcctgttcccgtcactgggtgacattgatcccagacacattctgatgactagtaaagttgcttttagtagccccagagccaggaggaataattcatatggaatttttaaagacgcccactcttggcgttaattacagcccaacgtacatttcttggggagattttcctgtgacaagtgaataccctctacattttcttaactggatgggaaaaggattttatgcccatacatcttgctaataaaccaaatcccttcttcagattcttgagtgaaacatttaaaatgtagtttctttagaaataaaagtatgaggcattttaaattatatgacagacaaaaaagtcaatgctcttgagctctttacagtaaataggttgtgtttactcataggatacagaatcatggatatcaaacatcaaaaataaattataaaaataatgtctcattttctgttgcatattattagcctgtctctcattccaccatttgttcttttgaactggaaaattgtgggctcctagtcactgcactaatctatctgaatatccaactaccagaaagggtttatcccatctcaagtttgtcagttgctttatatcgttaagggtgtttttgccaccctggttgtgttcataattaccattgagaaatgtcactgttattaaaatacattctgtgttccaacta

SEQ ID NO: 8898 - DNA, 2572 bp, Homo sapiens
gtcacctgggagcttttctggggctgtcaactggaacaccgcaggatttctccatgtggcctgggtttcctcataccaatggtggctaggttcccaagttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccagaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggaaacctcaaagctgcatgaatcacacaaggtaacaggtgccgagcaaggtctgcaggtttctggattgccagatagtgcagcacctgaaggaggtgcagcgcacacaaatgatcagcgcaggtgtcaaaggatgaagcagccacttacagaagtgcaaatcctcagccactcatcttaatccttaacaagacagcactccagataggcagccacgaccccaaaggcttctggaaccaaactgattaaagttttactcagtggatagttctatagaattaatgatgatgtatgccaaaaacctttcagtgattctaacttcaagcttggaaaaaaagacgaggcttcccagtgtttgtggtggtggatctgcctggttctcaatttgacaccctaagcgatcatactcaagaatagtacagatgtgtggaatacgccaatacctttaactacagacatcatgttctcaagataaaagcctttaaaacaaaaagccatcgtaggtatcaagtcaacatgaaattggaatgcaaaattaatactgctgaggatttccttcatatcccatgctgtttaactatctcttccacagtcctagaatcaatcttttttaattaagagacagggtctgtctttgttacccaggctggagtacagtggtgtcatcaaagctcagtgcagcctccaactcctgggctcaatactcttgcctcagcctcctcttcctgagtagctgcaactacagacacatgccccaatactcagctaatttttaaatttttgtggagatga

SEQ ID NO: 8899 - DNA, 3687 bp, Homo sapiens
ccaatggtaaaactaggaggacagccattttgcccacttgtaaaagagctaccttttcccacgagttggagcctgaggtgcggagtttcgtgagtttttactgactcgaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcagtagaattgattgtgaccaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagatattttggtaaaagacctcagtgggattgtagaggggcatcaaatcttaatgaacttcaccagctattaagtgacataatgattagaagattaaagactgaagttttaacccagctaccccctaaagtcagacagcgtattccatttgatcttccatcagcagctgccaaggaattgaataccagctttgaagagtgggaaaaaataatgagaactccaaattcaggtgccatggagacagtcatggggttgataactcgcatgtttaaacaaactgctattgccaaggcaggtgctgtaaaggattatattaagatgatgcttcagaatgattcgcttaaatttctggtttttgctcaccatttaagcatgctccaagcttgcacagaagcagtcatcgaaaataagactcgttacattaggatagatggaagtgtttcatcttcagaaagaatacatctggttaatcagtttcaaaaggatcctgacactcgcgtggctatcctaagcattcaggctgctggccagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccagaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagtaaagtagaaaaatatatgaatgaatgacaaatggtttacatgtggaagactttaatacagaagttttccatgtttgtttaatatatcgagagtaaaaattttcagaacaaaaatcaagaattcaaattctcttctactaattacttttagtattaaatacattttgaaagtacttaacagaaactaagatacaatactgaatatttctgtggtctttttgatttgattcagactcgcaattatgtttcagcaatgttttgtaaagctctttacccctaatatgcctaatcactgtattgtgcatagattgtgtttaaaaaatgtactctcaattacct

SEQ ID NO: 8900 - DNA, 2491 bp, Homo sapiens
actactgtttgcttttcctagttcgaaaaagaaaaacagcatgatattcgatcattttttgtaccacaacctaaaaaaagacagttgatgacctcctgtgacgaatcaaagagattccgggaggaaaatactgtagtgtcatcagaccctacaaaaacagctgcaagagatatcatcgattatgaaagtgatgttgaacctgaaacgaaaagattgaaattggctgcctcggaagaccactgcagtccgtcggaagagacaccatcccagtccaagcaaatccgaactccactcgtggaaagtgtacaggaggccaaggcccagttaaccaccccagcctttcctgtagagggctggcaatgtagtctctgcacctatatcaataattcagagttaccttattgtgaaatgtgtgagactcctcaaggcagtgctgttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccagaacagtggaagagttcagacactttgccagtgtatgacaccttaatgttctgtgcaagtaggaatactgaccggattcacatctatactaaggatggaaaacagatgagctgtaatttcattcctctggatataaaattagacctttgggaagatttaccagcaagctttcagctgaaacaatatcgctcactgattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaagatacataaccaaagaagatgttgccgtagcctcaatggacaaagtgaagaatgttgggggccatgtccgtctgatcacaaaggagtccaggccacgggatcctttcacaaaaaaacttcttgaagatggagcctgtgtcccatttctaaatccatacacagtccaggcagatctcactgtgaagccctctacatccaaaggctatttgcaagctgtggataatgaaggaaatccactttgccttcgctgtcagcaacccacttgccagactaagcaagcatgtaaagcgaactcttgggattcacggttttgctctctgaaatgtcaggaagagttttggattcgatctaataacagttacctgagagccaaagtatttgaaactgaacatggtgtgtgtcagctctgtaatgtgaacgcacaagaactctttttacgtctgagagatgcccctaaaagtcagaggaagaatcttctgtatgctacctggacttcaaagctcccattagaacagctaaatgaaatgataagaaacccaggggaaggacatttctggcaggtggatcacatcaagccagtgtatgggggaggaggacagtgttccctggacaacctgcagactctctgcacagtctgtcacaaagagagaactgccagacaagctaaggaaagaagccaggtgagaagacaatctctagcatcaaagcatggatcagacatcacacgatttttggtaaagaagctgcatgaatcacacaaggtaacaggtgccgagcaaggtctgcaggtttctggattgccagatagtgcagcacctgaaggaggtgcagcgcacacaaatgatcagcgcaggtgtcaaaggatgaagcagccacttacagaagtgcaaatcctcagccactcatcttaatccttaacaagacagcactccagataggcagccacgaccccaaaggcttctggaaccaaactgattaaagttttactcagtggatagttctatagaattaatgatgatgtatgccaaaaacctttcagtgattctaacttcaagcttggaaaaaaagacgaggcttcccagtgtttgtggtggtggatctgcctggttctcaatttgacaccctaagcgatcatactcaagaatagtacagatgtgtggaatacgccaatacctttaactacagacatcatgttctcaagataaaagcctttaaaacaaaaagccatcgtaggtatcaagtcaacatgaaattggaatgcaaaattaatactgctgaggatttccttcatatcccatgctgtttaactatctcttccacagtcctagaatcaatcttttttaattaagagacagggtctgtctttgttacccaggctggagtacagtggtgtcatcaaagctcagtgcagcctccaactcctgggctcaatactcttgcctcagcctcctcttcctgagtagctgcaactacagacacatgccccaatactcagctaatttttaaatttttgtggagatg

SEQ ID NO: 8901 - DNA, 2091 bp, Homo sapiens
agtgagccgagcagaggggccgcctccgcccgcacccagcatgcttcgccgaggctataaggcctctgaaaggcgaagacacttgagcgagaggctcagctggcaccaagaccaggcgctgagtagcagcatctacctcctacgagagatgggccccactggcttcctgctgagggaggaggagccggaatacatggatttccgagtttttctaggaaatcctcacgtttgtaactgttccacatttccgaaaggaggggaactttgtaagcatatctgctgggtcttgttgaaaaaattcaagcttccaaggaaccatgaatctgctttacaactgggtcttggagaaagagagataagtgacttgcttcgggggatacatcgagttcaaactccccaaccaggaacaaatgacgaaaatgaacatgttgaagaagatgggtacattaaacagaaggaaattgattcagaggatatctgctctatttgtcaagagctacttttagagaaaaagcttcctgtcaccttttgcaggtttggctgtggcaatagtattcatataaaatgcatgaagatcttagctaattatcagagtacatcaaacacttccatgttgaaatgtcctctgtgcaggaaagagtttgcaccattaaaactgattttggaggaattcaaaaactctagcaaactagtagctgcagcagaaaaagagagactggacaaacaccttgggattccctgtaataactgcaaacagtttccaattgaggggaagtgttataagtgtaccgaatgcatagaatatcacttatgccaggaatgttttgatagctgctgccatctttcccacacgtttacatttcgtgagaaaagaaaccaaaaatggagatcactagaaaaaagagcagatgaagttgtaaaatacatagatactaaaaatgagattgaagaaaagatgtcacattttcaagaaaagcaaggccaagtttacacaccaaaacacattgtaagatcactgcctctccaactgattactaagaatagtaagctgcttgctccaggctaccagtgtctactttgtttgaaggcatttcatcttggtcaacatacaagattgctaccatgtactcacaagtttcacaggaagtgtattgacaactggttattccacaagtgcaattcatgccctattgatggacaagttatatataaccctttaacttggaaaaattcagcagtgaatggacaagcacatcagtctgtttcaaacagagacatcattcatctatcaaagcagaaagaaccagatctttttattcctggtactggattagtcttaaaacaaaatagacttggaattttacctagcatacctcagtgtaattttgatgaattgaatacacctcaaagcccaaaagatgcctatgaaaatacaacaatagataatctatgctctatcaaattagataattcaaattcaaaaaaattaacctatgattataaaattagccaacattttcccaggtatcttcaagatttacccactgtgtcatttgggaaaataccatctcaaacactgcttcctcctattgttcataagaatattgtgtgtcccactgcaatggaaagtccatgcatcagtggaaaatttcacactagtctaagccggatgaccaaaggctgtaaatgtaataaccacaacctaaagaagactcctgccactaaaataagagaggacaacaagagatcaactttacttccagaggatttcaatcttattgtcaattggagcacagctaaacttagtttgtctaaaaggtatagtaactgtatgggggaaattacacgaaaatgtagtcatctatcaagacagcctgtgtctcactctgtaaatacaaaaagtactgagctatctttaataatagaaggagttcaattgtgaaaaagtttactatctgaaaatatttgaatgttgaatataaaaaaatgttttatatagaacataaaaagcacacatagtcttgacaaatgtatataaaattctctgttggaatttgcctacttacctataaacagctcactacacttaaa

SEQ ID NO: 8902 - DNA, 2773 bp, Homo sapiens
agatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgaccgacctgttcatccgcttcccagagaatctcttgctacaccgggtggagaacacccagggccacatcctctatgctttcttggtggagaacaaggaacgagaaagtcgagtggtgcactttgctgtgctcaaggcggagacagtcacctctgtggccaagatgctgagcatcttcacagagttcaactccgattggcccaaggtcaaggtggtctttgtggacccttcattccattaccgggctatcctgcaggagatctttcctgctgcccgcatcctcctttccatctaccacacaacccgactcttggagaagaagttgcatcgtagttcagcaaatccatcctttaaaaggctcatgaaggaagccctgcgggaggccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgggaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagacgcacagcaggtacaggtacagcagcagtcacaagtgccgccctcgcaggttggcatgctggacaccttgcaccagagtggctctgaactagcctacaagctgtgccacaatgagtgggaggtggtacagaactccacccacctggtggacatggctggctcttcagtggacgttcagctgctagaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaagaaggggagggattccctcctgctacagctgtgatgcattattgaagcactttagctgaagcattggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaagatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaa

SEQ ID NO: 8903 - DNA, 2765 bp, Homo sapiens
agatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgacacaaaaaacaaggtgatgaaaacaaggctggagagacaagcggagaccacaagtggtcacccctcactggcctcgctgtactactggactgctccagcccttcctggcccagagctagagatggcaccacccccgcactgtgcacacaataggtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgaccgacctgttcatccgcttcccagagaatctcttgctacaccgggtggagaacacccagggccacatcctctatgctttcttggtggagaacaaggaacgagaaagtcgagtggtgcactttgctgtgctcaaggcggagacagtcacctctgtggccaagatgctgagcatcttcacagagttcaactccgattggcccaaggtcaaggtggtctttgtggacccttcattccattaccgggctatcctgcaggagatctttcctgctgcccgcatcctcctttccatctaccacacaacccgactcttggagaagaagttgcatcgtagttcagcaaatccatcctttaaaaggctcatgaaggaagccctgcgggaggccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgggaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagacgcacagcaggtacaggtacagcagcagtcacaagtgccgccctcgcaggttggcatgctggacaccttgcaccagagtggctctgaactagcctacaagctgtgccacaatgagtgggaggtggtacagaactccacccacctggtggacatggctggctcttcagtggacgttcagctgctagaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaagaaggggagggattccctcctgctacagctgtgatgcattattgaagcactttagctgaagcattggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaaga

SEQ ID NO: 8904 - DNA, 4339 bp, Homo sapiens
taaaggggccgcatcaccctgccggcccggcgcgggtcgggggtgggtgcggtaggggtcccggggcggccgagcgcagaggacggacgggaaggagggcagggggcgcgggagccggcgaagcggagcgggcatcggaccgagccccccaaagaggccccgccccggccctggccccggccgggccggatggaaccccccgcggccaagcggagccggggctgccccgcgggacccgaggagcgcgatgccggggccggggccgcgcgtggccggggccggcccgaggcgctgctggacctcagcgccaagcgggtagccgagagctgggccttcgagcaggtggaggagcggttctcccgggtgcctgagcccgtccagaagcgcatcgtgttttggtcgtttccacgcagtgaacgggaaatatgtatgtactcgtcgctgggttacccgcccccagagggcgagcacgatgcccgggtgccctttacccgcgggctgcacctgctccagagcggggccgtggaccgcgtgttgcaagtgggattccacctgagcggaaacatccgcgagccagggagtcctggagagcccgagcgcctctaccatgtctccatcagctttgatcgctgcaagatcacgtccgtgagctgcggctgtgacaaccgcgacctcttctactgtgcccacgtggtggccctgtccctgtaccgcattcggcacgcccaccaggtggagctgcggctgcccatctccgagacgctctcccagatgaaccgggaccagctgcagaagttcgtgcagtacctcatcagcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctgggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcctggaaggggtgtgtgcttgggctgctggtatgaccccactttgggcaccccaaaagcaataggcaaactccccttacccagactggcttgggctccaggagggaggctgggaggcaggactttccagaaatcgaccctctaagtcaatgtagcacattttcccccaaccccaccctgggtggccaagggtcctcccccaccccctactgctcagggccccccattatgccacctccaaagtggctgcccagccaggaccattggctcacccccactgaaggaattgaagaggcctcaggcctcagcctcatacctcacccccttatcctatccggccaggacccccatttccttgggcactagggtcccagggtgggctcagggttggggaagtcctcgctgccctctcttctcacctgctagtcactggacgtacaactcaggaactgagcgaggctcacactgccccttccaacctggggttgggggacacagacgcgagagagccggagacccccacccccgatctggaaaggaaagagacctgtatcttggtgtttttctggctttttcaccctttcgcctcctgtctttctgcttcgccccttcatcttactctgtttccatttttcccggcacttacctgcctttctctctgcacctaagtccctgccgccctctctctttggccatccttcctttcccccaccttgacccagggaggagaagggagaacatcacccccccaagtcacccccacatcttttcccttcttgtatattaaggacaaaataccacatcattttgtaactttttttctatttattgaacggtgtattacatgtccttttcctttttttttttcaaagattgaacagaaatttttctttttaattttattttgagactggggtgcatctccagagccactcacaccctcaacctcgtttcctccgc

SEQ ID NO: 8905 - DNA, 2921 bp, Homo sapiens
agcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctgggggccctgtgggtttgcgtcgtcctgagcccccactgcaaaccagaggaaagggcaggctggctccagctactcagcaggtgggacaagctcgacgtctgcccactggaagagggcaactactccttcgacggccccagcctgcagcccaccatggcccccgccccaggctcggaggaagaggaagaggtggcagccacaagtccccgccacacggtatttggccgcgccttgctggctggagagctacactggaatgacgcctacctgcagaggatcctggccagtgactcctacgggcccagcctcacaggcagcgtgggtggggacaaaccgactttcgacccccagggccgcccactgtggctgggagaacctttccccactgcctgtgcccgtgtggacaccctgcgtgcccacggatacccccgccaggccctgcggctggcaagtgccatcatcaacacactccggctgcagcagcggcatcagctagagagctacaagcagcagaaaaaagagctgctccagaagggctccacctgcatcaccaacaccgaaggatgggtggggcaccccctggaccccattggctgcctctgcagggcgctcctggaggcctgtcgtctggaggaggagacacttaccctttacccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggggctgctgctggaagggggtcccttcagtggctttggggaggtgctgttccgggagagcgtgcccatgcacacctgtgcccgctacctgttcaccgcactgctgcctcatgacccggacctggcctatcgcctcgcgctgcgagctatgaggctgcccatactggagacagcatttcctgctggagaacctcatcccagcccgctggactccatcatgagcaaccgcttcccccgctggttcatccttggccacctggagacccgccagtgtgaactggcttccaccatgttgacggccgccaagggagaccccaagtggctgcacacggtactgggctccatccagcagaacatccactctccggccctgctctttaagctggcgcaggacgcctgcaagacagccaccccggtcagcgccccaccagacaccacgctgctgggcatcgcactggagctggggctgcaggtgatgcggatgactctgaacgtaatgacctggcggcggagggagatggtgcgctggctggtcagctgtgccacagagattggcccgcaagccctgatgaatatcatgcagaactggtattccttattcacaccagtggaggcggctaccatcgtggcagtgacgggcaccacacacgccactctgctgcgactgcagctggacacatcgcggagggaggagctctgggcctgcgcccgcaccctggccttgcagtgcgcgatgaaggaccctcagaactgcgccttgcctgccctgaccctgtgcgagaagaaccactcggccttcgaggcggcctaccagatcgtgctggacgcggcggccggcggcctgggccacgcccacctcttcactgtggcccgctatatggagcaccgcgggctgccgctccgggcctacaagctggcgacgctggccctggcgcagctcagcatcgccttcaaccaggacagccaccctgccgtcaacgacgtgctttgggcctgctctctcagccactccctgggccggcacgagctctctgccatcgtccccctcatcattcgcagcatccactgtgccccaatgctgtccgatattctgcgccgctggactctctcggcgcccggtctgggccccttaggggcacgccgggccgccaagccactgggtgccgaccgggcgccgctctgccagctcctggacgcggcagtcaccgcctacatcaccaccagccactcgcgcctcacgcacatcagcccgcggcactatggggatttcatcgaattcctgggcaaggcccgggagaccttcctgctggcgcccgacgggcacctccagttctcacagttcttggagaacctcaaacagacctacaagggcaagaagaaactcatgcttttggtgcgggagcgttttggttgagggacagtggggtgcgtgggagtggggatccccctcgcccctgcgtcccccacccttgctctccaattaggcccacgtggcatttcagtattattaagtcagggaaggagcccggctggagatgggggcagggggagcagcatcctgccacgtgtgtgcctgggagtctgtgagcaagtgtgcaagactccagaagcagaagccatactgccacccagaagcct

SEQ ID NO: 8906 - DNA, 5819 bp, Homo sapiens
ctgcaggccgcccgcgtctgccctcgcggcgcgctcccgggcccggccgcggttccccactcgggccggctggctcgcgggttctctcgccccgcccccctcggcgccaccgctgggcgcttgcgcggggcgcgtggccgtggccagggtctccgccgcagcccgagcagccgccgccgcctcagtcagtcagtcagtccccagcaatggcggacggaggtgagcgagaggagctgctctcgccgtcaccggtctctccggctaagcggcagtgttcgtggcccagcccgcaggctcatcaccctcgcggttcgcctggggcagccggcggaggggcagggggcgtcggcagcagctgcctggtcctcggggcccgcccccacctgcagccggattccttactggactgcgccgccaagacggtggcggaaaagtgggcatacgaacgggtggaggagcgcttcgagcggatcccggagcccgtgcagcgccgcatcgtctactggtccttcccgcggaatgagcgggagatctgcatgtactccagcttccagtaccggggcggccccggcgccggcgctgctggcggcgccgcgggggcttcgccggccgaggaggggccgcagccaccccccggggccgccgctccggccggctccgcccccgggggcgtcgcggctggggcatcccccgggctgggcgcaggggccggcgcggccggctgcggtggcgaggggctcccgttccgccggggcatccgtctgctggacagcggctccgtggagaacgtgctgcaagtcggctttcatctgagtggcacagtaactgagctggccactgcctctgaaccagcagtgacttataaagttgcaatcagttttgatcgatgcaaaatcacctcagtgacatgtggctgtgggaacaaggacatattctactgtgcccatgtggtagcactctcactctacaggatccgtaaaccagaccaagtcaaattgcgtcttcctatctccgaaacccttttccagatgaatagggaccagctacaaaagtttattcaatatttaatcacggcacaccacactgaagttcttcctactgcacagaaactggcagatgagattctatcctccaactcagaaatcaaccaagtgaatggtgcccctgaccccacagctggggccagcattgacgatgagaactgttggcatttggatgaagaacaggtgaaagaacaagtgaagctttttctctcccagggcggttactgtggctctggaaagcaactcaactcaatgtttgccaaggttcgagaaatgctgcggatgagagattccaatggagcaaggatgctgacactaataactgagcagtttgtggctgacccacgactcacactctggaggcagcaaggaacaaacatgacagacaagtgcaggcagctctgggatgagctaggggctttatgggtgtgcataattttaaatccacactgcaaactggaggagaaatcctgctggctgcagcagctgcagaagtggagcgacctggatgtctgtcccctggaggatggaaactatggacatgagctgcccaacatcaccaatgcacttccccagagtgccattcacagcccagactccttatccagaccaagacgaacagtattcactagagccattgaggggcgtgaattacattggcaggatagccacctacagcgaataatcagcagtgatgtttatacagctcctgcctgccagcgggaaagtgaaagactactctttaattcccaaggccagccactgtggcttgagcatgtgcctacagcctgtgctcgagttgacgccctgcgttcccatggttatccaaaagaggccctcagactcacagtggccattattaatactctgaggttgcagcagcagcggcaactggaaatctacaagcatcagaagaaagaactgttgcagagaggaaccacaaccatcacaaacctggagggctgggtgggccaccccctggatcccatcgactgcctgtttctcactttgactgaggcctgccgcctgaatgatgatggctatctggagatgtcagatatgaatgaaagcagaccccctgtgtaccagcatgtacctgtggctgcaggctccccaaacagcagtgagtcctacctgtcattggccctggaagttgcactgatgggcctgggtcaacagaggttaatgcctgaaggcctctacgcacaggacaaggtatgccgtaatgaggagcagctcctgagccaactccaagagctgcagctggacgatgagctagtgcaaacactgcaaaaacaatgcatcttactgctggaaggaggtcctttcagcggtctgggagaagtcatccaccgagagagtgttcccatgcatacctttgccaagtatttgttctcagctctgctgcctcatgatccagacctgtcctataaattagccttacgtgccatgaggttacctgttttagaaaactcagcttctgcaggcgacacatcccaccctcaccatatggtgtctgtggtgcccagccgttatcctcgctggttcacgcttggacacttggaatcacagcagtgtgaactggcctccaccatgctgactgctgccaaaggagacactttgagactccgaacaattctggaagcaatacagaagcacattcattcttcctccctcatcttcaaactggcccaagatgcattcaagattgctactcccaccgacagtagtactgacagcaccctgctcaacgttgccctggaacttgggttacaggtgatgcggatgaccttatcaacccttaactggagacgcagggagatggtacgatggttggtgacctgtgctacagaagtgggtgtgcgggccctggtgagcatcttgcagagctggtacacactcttcacccctactgaggctactagtattgtagctgccacagccgtatcccacaccactatcctgcgcctcagtcttgactatccacagcgggaggaactggctagctgtgctcgcacactggctctacagtgtgctatgaaggatccacagagctgtgccctgtcagcccttacactctgtgagaaagaccacattgcctttgaggcagcctaccagattgccattgatgctgctgctggtggtatgacccattcacagctgttcaccatcgcccgctacatggagctccgtggctacccgctacgtgccttcaagctggcctcattggccatgagccatcttaacctggcctacaaccaggatactcacccagccatcaatgatgtgctctgggcttgtgctctcagccactctctgggcaagaatgagctggcagctctcatccccctggtggtgaagagtgtgcactgtgccacagtgctttcagacatcttacgacgctgcacagtgactgcacctggcctggccggcatcccaggccgccgaagctctggaaagctcatgtccactgacaaagctccattgcgccagttgctggatgccaccatcaatgcctatatcaacactacacactcacgcctaacacacatcagccctcgccactatggagagttcattgagtttctaagcaaggctcgggagaccttcctgctgccccaggatggccacctgcagtttgcccagttcatcgacaacctcaaacagatctacaaaggcaagaaaaagttgatgctgctggtgcgagagcgctttggctgagagagcagatagctcactgccagagcagcctgggttcccaggtagtatcaggtcaggccaagggcactgaaacatttgtccaccctgagagaactctgagcacctgtggatgaggccaaaggaccacagggctaaggatggggaaagtccagctctagtcgataatgcctaccttggcaagcttctgactacagcctactgttcatggaggagctgggccctgcagatcgaccagaaaccccacaacatgccacctcatgcccctatatcctgcgtgtcctgagcattggccctgtctcccttggcaaacacagaacactgttccatctcagggattgcttaaccagagaaacagacacatttgtgggactgtaaatactatatgtgttgctaattattgtaaacttgtaactatttataattctgcttctgatttgatgggcacttgaagtagctgtgggtaggaggatatgcttattttctgaggagactcacaaccatttctcaggtttcccttgcagagtgtttgctggtagcagtggaagagtgggggtgccaaggagaaaaatggccagttaggatcaacccaagtctagtctatgcagaatcccccacctacagacagggcatttatagtccagtggtgagtgagggacagaggccaggactggacttagacttttgcctcacaaaactgtgaggacattgaagctcctgcctcacacagcctcttcaggagcctgctgaacacctgagaaacaagtgcagggagaagatgaaggtctgggaagccgctgagttcataatattcatctactgtggtcacctttgtgttagcaagtgtgtggtttcatctataattgtgtgtgtgtatctttatggctaagtacatgtgtgtatgtacatagatacatctgtgcatgcctgtttgtgcacatatatatttatgtgtatgtgtcagttctatggctgtgtacctgtttgaatatgtgcacactggactgtgagtttctacgtgaggatatacacattttgtgtacatgtgaggatgcacatctttgtgcaaatgcactcatgtttgtgcatgtttagtatgtgtatctgcgtacacgagtgcatgtgtataaacatgtttgtatccatgtgtatgcttgttatccatgcatctgtgtctttatatgtgtaactgagcgtatttctacatgtagggatgtctgtgtattcatgtttgaggatctgcatcaatgtgtcctttttgccagatttctctttcccattcctcttaaatctctctcgccagctaaacgtttgttccccatctctgtgcctcctctattcattctctcaccaaacaagcttctaagcaccaatctccctctgccatcagattggctgctttagctccatagttctcttctcgcctcatacttgctttcttcccctgcctttctacctcaagcttcctcgccggcttttgtcacagtctcattgctcgctgacttggaggctagggctggtctgcacttagcctctcccttcctaatttctagccctagtgggcagtcctgtcttagccctggctgacctccatagtgtatcatgttcctgctaccttcctgacccctgtgctcagcctggaattgttataggaggtagcaagggcactcagaaaagtcagttggaaccagtgtcttggtgtttactgtttcatgtcttagttcctgagttgggggtggggtttgatagggaaggggtggtatagctagaatgtgaactaagaacttctccatctgctttactttttctttcttcgacaaactgtcaccttttttactccaaactgaccaagaagttgtatttgccatttgtggctactcaagtcttactgtccagccaagggcccctacgtctcagcccaatgggttggttaaaaaaaagagagaagccactctcatttctgtatcacagttgcccttttttagcaagtgtgtgaattcacagtgcttttctatgaataaatcatggatcacataaaagatcatttttctaaaagca

SEQ ID NO: 8907 - DNA, 5501 bp, Homo sapiens
atggcggagcgcggacagcagcctcctcccgcgaaacggctttgctgccggccgggcggcggcggcggcggcgggggcagcagcggcggcggcggcggcgcgggtggcggctacagctctgcctgtcggccaggcccgcgggcgggtggcgcggcggcggcggcggcgtgcgggggcggcgcggcgctggggttgctgccgccgggcaagacccagagccccgagtcgctgctggacatcgcggcgcgcagggtggcggagaagtggccgttccagcgcgtggaggagcgctttgagcgcatcccggagccggtgcagcgccgcatagtctattggtccttcccccgcagcgagcgggagatctgcatgtactcgtccttcaacaccggcggcggcgccgcgggcggccccggcgacgacagcggtggcggcggcggcgcgggcggcggcggcggcggcggctcctcgtcttccccggccgcaacctcggcggccgcaacctcggccgccgccgccgctgccgccgccgccgccgccgccgccgccgccgcgggggccggggccccgtcggtgggggctgccggggcggcggacggcggcgacgagacgcggctgcctttccgccggggcatcgcgctgttggaaagcggctgcgtagacaacgtcctgcaagtcggtttccacttgagcggcacagtgacagaacctgcaatacaatcggagccagaaactgtttgcaacgtggccatcagctttgatcgttgcaagattacctcagtgacctgcagctgtggaaacaaggacatattttattgtgcccatgttgtggcactgtctttataccgcatccgcaagccagatcaggtcaaactgcatcttcctatttcagagactctctttcaaatgaatagagaccaactgcaaaagtttgtacagtatttgatcacagtgcaccacacagaagttttgccaactgctcaaaaattagcagatgaaattctttcccaaaattcagaaatcaaccaagttcatggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaactgagagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagtt

SEQ ID NO: 8908 - DNA, 11456 bp, Homo sapiens
aagccgcaggggccgccgtcgtctcctccgcgtccccgcccgccagctgctgtcggaggttgacaggtcgaggcggggaggcggcggcggcggctgcagagccaggcgcccaagacggagaccccatggggaacgctccgagtcacagcagtgaagacgaagcggcagctgccggtggcgagggctggggcccacaccaggactgggccgcggtctcgggcacgacccccggcccgggcgtcgcggctccagcgctaccacccgccgcggcgctgctggagccggccaggctgcgagaggctgctgcagcgttgctgcccacacccccctgcgagtcgctggtgtcgaggcatcgcggcgcgttgtttcgctggctggaagagcggctgggccgcggcgaagagtctgtcactctggagcagttccgggagctgctggaggctcgcggcgccggctgctctagcgagcagttcgaggaggcctttgcccagtttgatgctgagggtgatgggacagttgatgccgagaacatgttggaggccctcaagaattccagtggagctaatcttcagggggagctgagccacatcatcagacaactacaggcctgctctctggttccaggtttcacagacatattttcagagtcgaaggagggccttgatattcactcgtcaatgatactgcgcttcctgcaccgcaatcggctctccagcgcggtgatgccctacccgatgctggagcactgcaataacatgtgcaccatgcggtcttccgtcctgaaggagtctctggatcagctggtacaaaaggaaaaggaaagccctggagatctaactagaagtccagagatggataaactcaagtcagtagcaaagtgctatgcttatatagaaacatcctccaactcggcagacattgacaagatgacaaatggagaaacctcatcctactggcagtcagatggcagtgcctgttcacactggattcgtttaaaaatgaagccagatgttgtgcttaggcacctgtccattgcagtggctgccactgaccagagctacatgccacagcaggtgacagtagctgtagggaggaatgccagcgatcttcaggaagtccgagatgtgcacatccccagcaatgtcactggctatgtgacgctgctggaaaatgccaacgtcagtcagctctatgtccagattaacataaagcgttgtcttagcgatggctgcgacactagaattcatggtctcagggctgttggctttcagagagttaagaagtctggggtctcagtctcagatgcttctgcaatatggtattggtctctgctgacatctctggtgacggcttctatggagacaaatcccgcctttgtccagacagtgctgcacaatactcagaaggcgctgcggcacatgcctccactctctctctcaccaggatctacagatttctcaactttcctctcccctaatgtgctggaagaagtggacagtttcctcataaggataactagctgctgttctaccccagaggtagaactgactcttctggcttttgctctcgcaagaggaagtgttgccaaagtcatgagctctctatgcaccatcactgaccatctggacacgcagtatgatgcctcatccctcatcttgtccatggcgtcagtcagacagaacctgctcctcaaatatggtaaacctctccagttgactcttcaggcatgtgatgtcaaaggaaaagaagataagtctggacccgaaaacctccttgttgaaccgtggacaagggatggttttcttacggaaactggaaaaaccagagccagcactattttttctaccggaactgaatctgccttccaagttacacagataagaattatggttcgacgtggtggcattggtgcccagtgtgggttggtgtttgcctataactcatcttcagataaattttgtgcggaagaacacttcaaaaggtttgaaaaatatgacaaatggaagcttcaggagctcaggcaatttgtaaaaagcaggattggttgctcatctgatgaccttggagaggatgatcctattggctggtttgaactggaagaagaatgggatgaagcagatgtgaagctgcaacagtgcagagttgccaaatatttgatggtgaagttcctctgcacccgtcaggagtcagcagagcgcttgggagtgcaaggcttgaccatcagtgggtacctccggcctgcaagagcagaagcagaacagagcgtcacctgtgcacactgcagaaaggacacagaggagagtgtctgtggggccacgttgctcctcaggacccttcagtttatccagcagctcgcccatgacctggtgcagcagaaggaaagtggcttaaaatataaatcttttctggacttcgcgggtcttgatttgcagatcttctggaatttttacagtaaattaaagcaaaacccgagggaagaatgcgtctctgcccaaaccctgcttctgcagctactccagagctgcttctctgtgctgcagggagatgtactggctgcttctgaggaggaaaaggctccaatccaaagccctaaaggagtagaggctgccaaggagctgtacacacacttgtgtgatgtggtggacaaggtggatggagactctgtgcccatggagatactaaaacaagaagtcaggaatacccttctcaatggggctgccatcttctttcctaatcgacagacccgacggaaccatctcttcaccatgatgaatgtcaccgagcaggagcacaagcagtccctgcagctcactttccgttcactgtgcacgtattttagtgacaaggatccaggcggccttcttcttttacctgagaagaacgacctggccaagatgaacatcagtgaagtcctggcggtcatggacactctcgtctctgttgctgctcgagagtgcgagctgttaatgctcagtggggccccaggggaggtgggctctgtgctcttctccctgttctggtccgtccaaggcagcctgctatcctggtgctacctgcagctgaagagcacggactctggagccaaagatcttgccgtggaccttattgaaaaatatgtgggccagtttctggcaagcatgagagcgattttggaatcccttttctcacagtacagtggaaaaaccatagtagaaagattatgtaactcagtgttttcaatggcagctcgtcaactggttatcttcctgctggacttctgcactttagacatcccacactgcgtgctcttgagagagttcagcgtcctcacagaactcctgaagaagctctgtagtggccccgaaggaggactgaggaagctggatgttgagacctggcaacaggaacagcctgtggtgttacatacgtggacgaaggaatctgcccacaactatgaaaataattgccatgaggtatccgtctttgttagcccaggggcaacctattttgaagtggaattcgatgacaggtgtgaaactgaaaaaaggtatgattatctggaatttaccgacgctagaggtcggaaaacacgctatgacacaaaagttggcactgataaatggcccaagaaagtgaccttcaaggccggtcctcggttgcagttcctctttcactctgacagcagtcacaacgaatggggctacaaattcactgtcactgcctgtgggctgcccgatgttgccgtgtcttgggggctggatttacagctcctcgtctcccggctgatgggacgcctggcttcccagtgcatggcgctcaagtctgtgcgccagttaggaagtaacatggtagtacctcaggcaaaaatggcattagtcctaagctccccactgtggaaacctgtcttcaggcatcaggtttgtccagagttggaattagaagcaagctggcccactcacccacaccggaatagtaaggaggttaagaacattcctgacgacccctgccgccattttcttcttgattttgcccagtcagagcctgctcagaacttctgtgggccatattcagaacttttcaaaggattcatacaggcatgtagaaaacaggccccaaagacagatatagttgctggttccactattgatcaagctgtgaacgccacctttgctgctctggtgtatcgcactccagatttatatgagaagctgcaaaaatatgtcaacagtgggggcaaaatagccctgagtgaagagtttgcccaggtttattccttggcagatgggattcgaatatggatgttagagatgaagcagaagtccctgatgagcctggggaatgaagcagaagaaaaacatagttcagaagctactgaggtgaaccctgagagcctggcaaaagagtgcattgagaagagtcttctattactaaaatttctgcccacgggcataagttcaaaagaaagctgcgaaaagttggagactgctgatgaaaccagtcatctccagccactcaacaagcgtcagaggacaagctctgtggtggaagagcatttccaagcctcagtatctcccactgaagccgcaccccctgccacaggagaccagagtcctggcctgggcacccagccaaagctgccatccagcagtggccttcctgctgcagacgtgtcccctgccacagctgaagagcccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcgcagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 8909 - DNA, 2026 bp, Homo sapiens
gagtcctcgcggggcgtgttgcgtgcggaggtcaggctgccaccctctgtagttccctaaccccaaactcggagacttctaagagccacaccaccaaggaacttctagtcctggaggtcaatggtggggcaaacctcgcctcaattctttgaccccctcgggtcgtaagcagggctaagaggctgcgaagaagaggcctggccatgggtgtatgggggaagaaacatctcaggctcactcatgccccctccccgaccttctcccacctgccgccatccccgcaggctggggagccaggaatcgacgggatttctctggctgtcgtttgcgctgcatttatccgaatacatccagctcgcaggcatcctgcaagaaacggctcccggctcgcgtgtacgccgacacctcggcccaacgcaggactcgaggtggtttctagtgcccgggtggctgcaagtctgccctccgagggaggctggacaagcggcgcccccaggtcgagcggcctctcgctgcctggcagtgcctggcagcccccacctctgccagtgcttcggaaacccgcctggccaggttcgcccgcggtgaaaaatgaaagcaaattccccaacagaggtagccggaactttcctcgacgaaggctccctcctgcgcctgtgtctggagaacccccagagcgctgcaagttagcaagagagattcgatggcggctctggaaggcgcacgaagggtggggcgggggagcaaagaggccactgggtgacccagcctggtccggggtgaaacgctagagaaggcgcctcgccttccttatttcaatgcaactcctcggccccagacggtaaaaatagtttccaagctgccgcggacgcccaggatgtgtttgcagagatcaaactggggaggaggcagctttgtaaaagttgcagaaagattagccgagaagcgtccgcccggcggggctcaagaaagcttggggacagctccatgttccttggggcggaatggcccaagaattggcctgggtaaccccctgcccagttctctgtcctcacttcgagccagtgcttaaataacttcccgccgcctgccctgcaaacttcccggcgcggcgccgttgaggccaggacacagcaaaggctagcaaaaccccgccgcggcgcgctcggccccggccctgagaggctgcgcgggtgggaggaccagtgtggtttctgctcccactcggctgcccagaccctcaagaccgatcccccaactcctgggagcgggtgcttccctctgggagccgagatcttgcggggccagcgagggcgcaaagtgcgcgcgctggcccgcgcgggggcggccgcgcgtctctccgcggggcctgtcgccaggccggccgcggcgcgtgagtgatgagggcagagaagggcgcccataaatcgcgggtgtcagggcgaaaaactctctttattgtctgcgtgatggatgggcccggggacgagacaccaaatacttcgtatcgcctttaaatgggaacacattttccgcggccataattcatgttttttaaatagaaagtttgaaatgttgcctatatttcaccagccctgacatatttatgaatcgctccctgcatgcaaatatcattacttaaagcgccggggagagcgcgggggaggggaggaggcgcggttcccggggcgtgggggtggtgaaccggggaaatatcggtggaggggggccatctccctaaagggcagagggtgaggtgcggtgaatagccgtatccggaaaccgagcgtgccccgggcttctttcccgccgccagaccccgcacagccgccctgggacgtttttcgaggcttgggacctaagacgggtccccggaccctgctgggaaaccagggggcgtttttcgtccctctctgaggccattatccaagctgaaaccaccttttataagaaaaaagtttaaagaaaaaaaatttaacaaacacaaataataataataacccaacatgtttcgcgttctttgcca

SEQ ID NO: 8910 - DNA, 8514 bp, Homo sapiens
tcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 8911 - DNA, 8713 bp, Homo sapiens
tcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 8912 - DNA, 8036 bp, Homo sapiens
tcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacatcacctgcttccagagcacctgcaaacccaaccagatatgctgggccctggatgggctgctccgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagaagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 8913 - DNA, 8375 bp, Homo sapiens
tcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtgggcgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 8914 - DNA, 4469 bp, Homo sapiens
aaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggcaagctgactgacagaacagccagcattttccgaggcaaccaaatgaaactgaagctggtcaatatccaaaaagctaaaatctctacagctgcattcataaaagccttctgccgtcataagctcattgaactgaatgctactgcagtgcacgctgacctcccagttccagacatcataagtggactctgcagcaataggtggatccagcaaaacctccagtgtctcctgttagactcgacaagcatccctcaaaattcaagattactgttctttagtcagctcactggtcttcgcattttaagtgtttttaatgtttgttttcatactgaagacctggctaatgtttctcagttaccaagactggaaagcttagatatctctaatactctagtcactgatatttctgcactgcttacctgtaaggatcgattgaagtctctcacaatgcactatctgaaatgcctggccatgaccaaatcacaaattcttgcagtcattagagaacttaaatgtctgcttcaccttgatatttctgatcacaggcaactcaaatcagacctagcttttcatttgctacagcagaaggatatcctgcccaatgttgtgtcattggatatttctgggggcaattgcatcactgatgaagctgtagaactgtttatacgactgcggcctgccatgcaatttgtgggactattggccacggatgctggctcttctgacttctttactacaaagcaaggcttgagggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcagttacagaagaattgtcttctctccttaaccaattccaggattcttgtggatgttccatttgacaggtttgatgctgccaagtttgtcatgagatggctctgtaagcatgaaaaccccaagatgcaaacaatggcagtgagtgtcacctctattctggctctgcagctctcacctgagcaaacggcacagcttgaagagcttttcatggcagttaaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggagaccttttcagagtcagcaatacaaagcaaagtacttggtcttttgaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatttatctatggctgggtatggtggctcacgcctgtaatcccagcactttgggaggccaaggcaggtggattgtctgaactcaggagttcgagatcagccttgccaacgtggtaaaactccgtctctaccaaaaaatacaaaaattagctgagcgtggtggtgtgcacctttactcctagctacttggaggctgaggtgggaggaccacttgagcccaggaggcagaggttgcagtgagctgagattgcaccactgcactccagcctggatgacagagtgagacctcatctcaaatgaatagaggggtggagaaaagagaaatatatttttttacctttttttttttttttttttttgtgacggaatctcgctctgtcgcccaggctggagtgcagtggcacaatctcggctcactgcaacctctgcctcccaggttccagcaattctcctgcctcagcctcctgagtagctgggactacaggcacatgccgccacgcccggctaatttttgtattttttagtagagacagggtttcaccatattggtcaggctggtctcgacctcctgacctcgtgatccacccgtctcggcctcccaaagtgctgggattacaggtgtgagtcactgcacctggcctttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacattttaggattagatttttgtgcttttggctggcttggttcagattcttaactagagtaccatgtactgtctttggaaatcaaatgaggaagaagctcattctcttactctaaaccatgttccaaactattaccagagtccaaccagataagcagaatttgtaaccttacttccttccatagtccttaaactgtactgtattttttcacactcttgcatgattccaaaaggatatcttcctgacctgggttctagtacctcagagcattgttatcagatgctagcttattctaatgtgaggatgtgttaggggaactagtgtgttaagtccaattctgtacaagacatcctttcaagttctgtgtcattcacaacaatcctcacgggtaggtgagttttattttcctcacttaacagatgagaaaaa

SEQ ID NO: 8915 - DNA, 3942 bp, Homo sapiens
gggaatatcctctcaagccctgaggtgcagggctgggaaggagtgggtgagcggctgggtcgtggcaggttggtctggggaggctggggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcagttacagaagaattgtcttctctccttaaccaattccaggattcttgtggatgttccatttgacaggtttgatgctgccaagtttgtcatgagatggctctgtaagcatgaaaaccccaagatgcaaacaatggcagtgagtgtcacctctattctggctctgcagctctcacctgagcaaacggcacagcttgaagagcttttcatggcagttaaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggagaccttttcagagtcagcaatacaaagcaaagtacttggtcttttgaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatttatctatggctgggtatggtggctcacgcctgtaatcccagcactttgggaggccaaggcaggtggattgtctgaactcaggagttcgagatcagccttgccaacgtggtaaaactccgtctctaccaaaaaatacaaaaattagctgagcgtggtggtgtgcacctttactcctagctacttggaggctgaggtgggaggaccacttgagcccaggaggcagaggttgcagtgagctgagattgcaccactgcactccagcctggatgacagagtgagacctcatctcaaatgaatagaggggtggagaaaagagaaatatatttttttacctttttttttttttttttttttgtgacggaatctcgctctgtcgcccaggctggagtgcagtggcacaatctcggctcactgcaacctctgcctcccaggttccagcaattctcctgcctcagcctcctgagtagctgggactacaggcacatgccgccacgcccggctaatttttgtattttttagtagagacagggtttcaccatattggtcaggctggtctcgacctcctgacctcgtgatccacccgtctcggcctcccaaagtgctgggattacaggtgtgagtcactgcacctggcctttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacattttaggattagatttttgtgcttttggctggcttggttcagattcttaactagagtaccatgtactgtctttggaaatcaaatgaggaagaagctcattctcttactctaaaccatgttccaaactattaccagagtccaaccagataagcagaatttgtaaccttacttccttccatagtccttaaactgtactgtattttttcacactcttgcatgattccaaaaggatatcttcctgacctgggttctagtacctcagagcattgttatcagatgctagcttattctaatgtgaggatgtgttaggggaactagtgtgttaagtccaattctgtacaagacatcctttcaagttctgtgtcattcacaacaatcctcacgggtaggtgagttttattttcctcacttaacagatgagaaaaa

SEQ ID NO: 8916 - DNA, 8093 bp, Homo sapiens
tacgctcctagcttgagggaaagaggccgaggcctgggccaagcccggagccgccgctcgccggagcctcctggagcctccgcgccggctcagcctgggggcgggctccggtccggcccgccgccgcacccaggacggaggctgcatgcccgaggaccaggccggcgcagccatggaggaggcgtctccctattccttacttgatatctgcttgaatttcttgactactcaccttgagaagttctgttcagccagacaagatggaacattgtgtctgcaggaacctggagtattcccacaggaggtggctgatcgactgcttcggaccatggcttttcatggtctattgaatgatggaactgtgggtatttttaggggcaaccagatgcgcttaaagcgagcctgcattcgcaaagcaaagatctctgctgttgctttccggaaagctttctgccaccacaagttagtggaacttgatgccacaggtgtgaatgctgatatcacgattacagacattatcagtgggcttggcagtaacaaatggatccagcagaatctccagtgcctggtgctgaattcattaactctctccctcgaggatccttacgagcgctgcttcagccggctttctggccttcgagctttaagcatcacgaatgttctcttttacaatgaagacctggctgaagttgcctcattgccaagattagagagcttggatatttctaacacctcaatcacagacatcactgctctactggcctgcaaagaccgactcaagtctctaaccatgcaccacttgaaatgtttaaaaatgacaactacccagatactggatgtagttcgggaactcaaacatctgaatcatcttgatatctcagatgataaacagtttacatcagacatagctcttcgcttactagaacaaaaagacatcctacctaaccttgtttctctggatgtttctgggagaaagcacgtgacagataaagccgttgaagcctttatacaacaacgtccaagcatgcaatttgtaggtttgctggctactgatgctggttactctgaattcctcacaggcgaaggacatttgaaggtgtctggggaagccaatgaaactcagattgcagaagcactgaagcgttacagtgaacgggcattctttgttcgggaagctctatttcatctttttagtctgactcatgtgatggaaaaaacaaagccagaaattttaaagcttgtggttactgggatgagaaaccaccctatgaatttgccagtgcaactggctgcaagcgcctgtgtatttaacttaaccaagcaggatcttgctgcagggatgcctgtccgactcctggctgatgtgacccatttgctgctcaaagccatggaacattttcccaatcaccagcagttacagaagaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatccttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcccatgtgaacagtctctaatttgtcttgtgattttaaacttatgagtcaagaagggtctcttcctttatcattgccttttaggaaattttccacatctttcagtgtttgaacttacttgtgcttgagattctacagttttatggtaaagtttgcacgaacccttaggccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtgaaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgccaaaaatgaaagaaaataattaaactctttaaatgattaaatgtaatgattctactcgcagtgcataacagcacatatttttgacagattattttttaggcaattacctttccttaaggtatctgatacagtatagtaaagaatcacttatatcagtaatagcacttgagagatagcaagtcaccaagaaacttaattttcatttaaaattttattttgtgaataaggtcaatctacaatcccagataactacattttttttcatagatggccagtgttttcaacagagatttaaaatggaatattaaaattatagtgattattcagaagcattttaatttagaaaggagctggtttgttagttcactgatgacattttttgacaaacattttataccattatcacaataatcagacttgaattttttttggagttccttcatgtgaatgaaaactgagttaaaagaaagtaggcatttaggtctggatgcagtggctcatgcttgtaatcccagcactttgggaagctgaagcaggaggattgcttgagcccagaagttcaagactagcctgggcaacatagtgagactcggtctctaccaaaaaaaaaaattttttttttttaaattagctgggtgtggtggcacctgggaaacagagcgagacgctgactcaaataaatatctaaatagatatttagaatcactgaaaaccatattaaatgctgggttaatgctgacttaattggcttaaggaatttttataggcgtaagataaattttcacagactaagtttatttcagacaaaatagagaattcttttaaaagttttttttttttttttcctttttcgaatgttaatgtctaagacaaagttcagaaaacgagatggcctgtggtagtttggaaattgctagatatgttgaccgtttccaggtcttttatctagtgtagttaagggaaagcctatttaagaagtttggcttcaagtttctgttttataagacaaaagtgcatatttctttacaggctaatgctaggtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtaatcccagcattctgggaggccgaggcgggcagatcacttgagatcaggagttcgagaccaccctggccaacgtggtgaaaccccgtctctactaaaaatacaaaaactagctgggcatggtggcttttttgcacgcctatagtcccagctactcgggaggctgaggcacgagaatcacttgaacccaggaagtggaggttgcagtgagctaagatcgtgccactgcactccagcctggacaacggagtgagactctggggaaaaaaaaaattaaacttcctactttttttctttttgtagagacagagtttcactctgtcgcccaagctggagtgcagtggcacaatcatacctcactgcagcctcttgggcttatgtgatcttaccccctcagcctctggagtagctggaactacaggctaaatttcctactttgtaaacatcagtagtggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaagcataataatttattacatcccaaatatataaaaatttgagtgcctttgcagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaatttgactttttagagtataatgatgttctagggcataatgaggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttaggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggaccttttgtgttaatctgttttctccccagtcatcttatttggctatgttaaaaaaaaaaaaaaaaaaaaagcgagagagagagatggtgtctcactgtgttgcccaggctggtctcgaactcctggcctcaagtgactttcccacctcagcttcccaaagtgctggaatcacaggcatgagccacagtgcctggtcttagctgtgtttttaattatgccatgcatcaacataacaccgggccatcttcctatcccttcctatcccatatgtttaatgaaaacatattttatgtgctaaattaggttaatttaccagagatttagcttagtgtttttaaactatagaacaatacccctatagaacaatgtacagctgcacccaaggttaaaaagaggtagcagggaaaacaaacttaaactctttgtatatggtgaaacccatccctctcctgccctctaatggtatgtttacattatttcgttattatacaatgtagtggtataaacagtattattaaactgaaggcataagttaaaggaagtatgttactttgagctgatgtaggctcttccacttttatctgtattttacttatttggggactttgtattgctagggcttcagaatactaactttgacacagctcccagagaggtttgcaaacttttggtttccctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactggtagcctaagaaagagacttttcttcctgtttttctctctccccattttttggggtaagttttgcaaagatcagtgctgcttctcatgactctaaagtaaagctcttttggatagcacagcctaactttacagctagacagaatggccattaagaatatttccaaaatccaagtttatcaaaattattttgtgggaaatcatcaatctattttattaatgttatgtgtttaattttggacttattttgggaaaaactgttcaaattgggtccttttaagcttattttaagcagcctagaaggaagaagctacttagctaatgaaagctgagacactttattaaaagcaggatcttaagagcattgtttttccttaaaaactttatactctcagataatctgcaacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaattttatgtaaa

SEQ ID NO: 8917 - DNA, 2325 bp, Homo sapiens
gagtctgcgctctggttcgggctgcggctgcggctgcggctgcggctgctactgctacgctcctagcttgagggaaagaggccgaggcctgggccaagcccggagccgccgctcgccggagcctcctggagcctccgcgccggctcagcctgggggcgggctccggtccggcccgccgccgcacccaggacggaggctgcatgcccgaggaccaggccggcgcagccatggaggaggcgtctccctattccttacttgatatctgcttgaatttcttgactactcaccttgagaagttctgttcagccagacaagatggaacattgtgtctgcaggaacctggagtattcccacaggaggtggctgatcgactgcttcggaccatggcttttcatggtctattgaatgatggaactgtgggtatttttaggggcaaccagatgcgcttaaagcgagcctgcattcgcaaagcaaagatctctgctgttgctttccggaaagctttctgccaccacaagttagtggaacttgatgccacaggtgtgaatgctgatatcacgattacagacattatcagtgggcttggcagtaacaaatggatccagcagaatctccagtgcctggtgctgaattcattaactctctccctcgaggatccttacgagcgctgcttcagccggctttctggccttcgagctttaagcatcacgaatgttctcttttacaatgaagacctggctgaagttgcctcattgccaagattagagagcttggatatttctaacacctcaatcacagacatcactgctctactggcctgcaaagaccgactcaagtctctaaccatgcaccacttgaaatgtttaaaaatgacaactacccagatactggatgtagttcgggaactcaaacatctgaatcatcttgatatctcagatgataaacagtttacatcagacatagctcttcgcttactagaacaaaaagacatcctacctaaccttgtttctctggatgtttctgggagaaagcacgtgacagataaagccgttgaagcctttatacaacaacgtccaagcatgcaatttgtaggtttgctggctactgatgctggttactctgaattcctcacaggcgaaggacatttgaaggtgtctggggaagccaatgaaactcagattgcagaagcactgaagcgttacagtgaacgggcattctttgttcgggaagctctatttcatctttttagtctgactcatgtgatggaaaaaacaaagccagaaattttaaagcttgtggttactgggatgagaaaccaccctatgaatttgccagtgcaactggctgcaagcgcctgtgtatttaacttaaccaagcaggatcttgctgcagggatgcctgtccgactcctggctgatgtgacccatttgctgctcaaagccatggaacattttcccaatcaccagcagttacagaagaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagctcttcattgtcaggaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatccttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgaca

SEQ ID NO: 8918 - DNA, 2294 bp, Homo sapiens
ggttcgggctgcggctgcggctgcggctgcggctgctactgctacgctcctagcttgagggaaagaggccgaggcctgggccaagcccggagccgccgctcgccggagcctcctggagcctccgcgccggctcagcctgggggcgggctccggtccggcccgccgccgcacccaggacggaggctgcatgcccgaggaccaggccggcgcagccatggaggaggcgtctccctattccttacttgatatctgcttgaatttcttgactactcaccttgagaagttctgttcagccagacaagatggaacattgtgtctgcaggaacctggagtattcccacaggaggtggctgatcgactgcttcggaccatggcttttcatggtctattgaatgatggaactgtgggtatttttaggggcaaccagatgcgcttaaagcgagcctgcattcgcaaagcaaagatctctgctgttgctttccggaaagctttctgccaccacaagttagtggaacttgatgccacaggtgtgaatgctgatatcacgattacagacattatcagtgggcttggcagtaacaaatggatccagcagaatctccagtgcctggtgctgaattcattaactctctccctcgaggatccttacgagcgctgcttcagccggctttctggccttcgagctttaagcatcacgaatgttctcttttacaatgaagacctggctgaagttgcctcattgccaagattagagagcttggatatttctaacacctcaatcacagacatcactgctctactggcctgcaaagaccgactcaagtctctaaccatgcaccacttgaaatgtttaaaaatgacaactacccagatactggatgtagttcgggaactcaaacatctgaatcatcttgatatctcagatgataaacagtttacatcagacatagctcttcgcttactagaacaaaaagacatcctacctaaccttgtttctctggatgtttctgggagaaagcacgtgacagataaagccgttgaagcctttatacaacaacgtccaagcatgcaatttgtaggtttgctggctactgatgctggttactctgaattcctcacaggcgaaggacatttgaaggtgtctggggaagccaatgaaactcagattgcagaagcactgaagcgttacagtgaacgggcattctttgttcgggaagctctatttcatctttttagtctgactcatgtgatggaaaaaacaaagccagaaattttaaagcttgtggttactgggatgagaaaccaccctatgaatttgccagtgcaactggctgcaagcgcctgtgtatttaacttaaccaagcaggatcttgctgcagggatgcctgtccgactcctggctgatgtgacccatttgctgctcaaagccatggaacattttcccaatcaccagcagttacagaagaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgggttaatatgattatttgatacagaagttggctcaggtcatctgaaacggaaagaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatcgtatgtacc

SEQ ID NO: 8919 - DNA, 1174 bp, Homo sapiens
ttagactgcgcctgagcacctgagagcggatggagcgctttgtccgtgttccctatggcttgtaccagggttatgggagcacagtgcctttgggccagcctggactctcagggcacaaacagcccgactggaggcaaaatatgggtcctcccacttttctggccaggccagggctgctggtgcccgcgaacgcccctgactactgcattgacccttacaagagggcgcagcttaaggccattctctcccagatgaaccccagcctgagcccgcggctgtgcaagcccaacaccaaggaggtgggcgtgcaggtgagcccgcgggtggacaaggctgtgcagtgctctctggggcctcgcaccctcagcagctgctccccctgggacggcagagacccccaggagcccctgccagcctgtggggtcacttcgcccgccaccggccgcaggggcttgatccgcctgcggagagatggggacgaagcggagagcaaggcgctcccgggccctgcggaggccagccagccgcagccaccatcacggaggtcaggagctgacaggcaggaggagcccgggcagctggaggaatcgggggagaaagacgccccgtgccctcaggagacgaagagcaagcaggtgcctggagacgccgcctccgagccgctccggaggcccaacttccagtttttggaaccaaaatatggctatttccactgtaaagattgtaagaccaggtgggagagtgcttacgtgtggtgcatttctggaacgaacaaggtttatttcaaacaactctgttgtaaatgccaaaagagttttaacccttatcgagtagaagcaatccaatgtcagacctgctcaaagtctcattgttcctgtcctcaaaagaagagacacattgatctaaggaggcctcatcgacaggaactgtgtggtcgctgcaaagacaagagattctcctgtggcaatatttacagctttaaatatgtgatgtgacttgtacagtgtgacttgtaatggacccctgagctcttcttgtaacttactgtgctgtcttccttttttgcaacttggctctgacctggcatcggaaaatggctaggcttttgtactttttgtagattgtgtaacaattgtacaatgtgaatagaataaaataaatgcatgtgaactag

SEQ ID NO: 8920 - DNA, 493 bp, Homo sapiens
agtatctgaccgaataaagcgggagctggagattcggatcacctgtcttcctcgcaggctgaactggaagacctgacttcatctccgaattcgttggttctgtaacatgcctaatacaaggctgaatagggtttgttgtaagacctacaaaaccttcaaatggattcagtgagagttgctcccatgggggccttgctgcttccagaaggtgcttgagcagtaaacagaagcaaccttggattaggaaaaggggtaataagcagcagctcccattagaatctgaaataaatggagaagccaggaatgaatctgaaccaacctgatgaagagaaagaaggggcggatgaaggaggaaggcaaaataaggacccaaacaaactggctaggatattagactgcgcctgagcacctgagagcggatggagcgctttgtccgtgttccctatggcttgtaccagggttatgggagcacagtgcctttgggccagcctgg

SEQ ID NO: 8921 - DNA, 677 bp, Homo sapiens
agggcttggacctggtataaaacatctggaagtttccagggggctgctttgcatctgaaactgtcagccccagaatgttgacagtcgctctcctagcccttctctgtgcctcagcctctggcaatgccattcaggccaggtcttcctcctatagtggagagtatggaggtggtggtggaaagcgattctctcattctggcaaccagttggacggccccatcaccgccctccgggtccgagtcaacacatactacatcgtaggtcttcaggtgcgctatggcaaggtgtggagcgactatgtgggtggtcgcaacggagacctggaggagatctttctgcaccctggggaatcagtgatccaggtttctgggaagtacaagtggtacctgaagaagctgttatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccagtagctgcagcagatgctgagcctcctctccttggcaggggcactgtgatgaggagtaagaactcccttatcactaacccccatccaaatggctcaataaaaaaaatatggttaaggct

SEQ ID NO: 8922 - protein, 162 aa, Homo sapiens
  MOD_RES (93)..(93): Selenocysteine
MAAGPSGCLVPAFGLRLLLATVLQAVSAFGAEFSSEACRELGFSSNLLCSSCDLLGQFNLLQLDPDCRGCCQEEAQFETKKLYAGAILEVCGCKLGRFPQVQAFVRSDKPKLFRGLQIKYVRGSDPVLKLLDDNGNIAEELSILKWNTDSVEEFLSEKLERI

SEQ ID NO: 8923 - protein, 121 aa, Homo sapiens
  MOD_RES (93)..(93): Selenocysteine
MAAGPSGCLVPAFGLRLLLATVLQAVSAFGAEFSSEACRELGFSSNLLCSSCDLLGQFNLLQLDPDCRGCCQEEAQFETKKLYAGAILEVCGCKLGRFPQVQVCPWFRPCIKAFGRQWEHC

SEQ ID NO: 8924 - protein, 141 aa, Homo sapiens
MAAGPSGCLVPAFGLRLLLATVLQAVSAFGAEFSSEACRELGFSSNLLCSSCDLLGQFNLLQLDPDCRGCCQEEAQFETKKYSSIVSKQECHHSNCMQELFLKFVDENWEGSLKSKLLLGVINPNCSEDCKSSMSVVQTLY

SEQ ID NO: 8925 - protein, 568 aa, Homo sapiens
MSHRSDTLPVPSGQRRGRVPRDHSIYTQLLEITLHLQQAMTEHFVQLTSRQGLSLEERRHTEAICEHEALLSRLICRMINLLQSGAASGLELQVPLPSEDSRGDVRYGQRAQLSGQPDPVPQLSDCEAAFVNRDLSIRGIDISVFYQSSFQDYNAYQKDKYHKDKNTLGFINLGTSENKLCMDLMTERLQESDMNCIEDTLLQYPDWRGQPFLREEVARFLTYYCRAPTRLDPENVVVLNGCCSVFCALAMVLCDPGEAFLVPAPFYGGFAFSSRLYAKVELIPVHLESEVTVTNTHPFQLTVDKLEEALLEARLEGKKVRGLVLINPQNPLGDIYSPDSLMKYLEFAKRYNLHVIIDEIYMLSVFDESITFHSILSMKSLPDSNRTHVIWGTSKDFGISGFRFGALYTHNKEVASAVSAFGYLHSISGITQHKLCQLLQNTEWIDKVYLPTNCYRLREAHKYITAELKALEIPFHNRSSGLYVWINLKKYLDPCTFEEERLLYCRFLDNKLLLSRGKTYMCKEPGWFCLIFADELPRLKLAMRRFCDVLQEQKEALIVKQLEDAMRE

SEQ ID NO: 8926 - protein, 87 aa, Homo sapiens
MAKHLKFIARTVMVQEGNVESAYRTLNRILTMDGLIEDIKHRRYYEKPCCRRQRESYERCRRIYNMEMARKINFLMRKNRADPWQGC

SEQ ID NO: 8927 - protein, 542 aa, Homo sapiens
MNGKRPAEPGPARVGKKGKKEVMAEFSDAVTEETLKKQVAEAWSRRTPFSHEVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSRLSISGWFHGPSLTRPPNYFEPPIPRSPHIPQDHEILYDWINPTYLDMDYQVQIQEEFEESSEILLKEFLKPEKFTKVCEALEHGHVEWSSRGPPNKRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLTVNPESNSLALVYRDRETLKFVKHINHRSLEQKKTFPNRTGFWDFSFIYYE

SEQ ID NO: 8928 - protein, 386 aa, Homo sapiens
MNSLMPCCAFILYLVPPWDRSMGGTLDLYSIDEHFQPKQIVKSLIPSWNKLVFFEVSPVSFHQVSEVLSEEKSRLSISGWFHGPSLTRPPNYFEPPIPRSPHIPQDHEILYDWINPTYLDMDYQVQIQEEFEESSEILLKEFLKPEKFTKVCEALEHGHVEWSSRGPPNKRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLTVNPESNSLALVYRDRETLKFVKHINHRSLEQKKTFPNRTGFWDFSFIYYE

SEQ ID NO: 8929 - protein, 542 aa, Homo sapiens; identical to SEQ ID NO: 8927

SEQ ID NO: 8930 - protein, 350 aa, Homo sapiens
MATVGAPRHFCRCACFCTDNLYVARYGLHVRFRGEQQLRRDYGPILRSRGCVSAKDFQQLLAELEQEVERRQRLGQESAARKALIASSYHPARPEVYDSLQDAALAPEFLAVTEYSVSPDADLKGLLQRLETVSEEKRIYRVPVFTAPFCQALLEELEHFEQSDMPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 8931 - protein, 290 aa, Homo sapiens
MVELEQEVERRQRLGQESAARKALIASSYHPARPEVYDSLQDAALAPEFLAVTEYSVSPDADLKGLLQRLETVSEEKRIYRVPVFTAPFCQALLEELEHFEQSDMPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 8932 - protein, 340 aa, Homo sapiens
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQMADHTEVMKGIHQYPGVRYPVLTPNLQGFHHAVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 8933 - protein, 53 aa, Homo sapiens
MGNVPSAVKHCLSYQQLLREHLWIGDSVAGALDPAQELQSVMLMLHHGPLRKP

SEQ ID NO: 8934 - protein, 370 aa, Homo sapiens
MGNVPSAVKHCLSYQQLLREHLWIGDSVAGALDPAQTSLLTNLHCFQPDVSGFSVSLAGTVACIHWETSQLSGLPEFVKIVEVGPRDGLQNEKVIVPTDIKIEFINRLSQTGLSVIEVTSFVSSRWVPQMADHTEVMKGIHQYPGVRYPVLTPNLQGFHHAVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 8935 - protein, 371 aa, Homo sapiens
MAAPALRLCHIAFHVPAGQPLARNLQRLFGFQPLASREVDGWRQLALRSGDAVFLVNEGAGSGEPLYGLDPRHAVPSATNLCFDVADAGAATRELAALGCSVPVPPVRVRDAQGAATYAVVSSPAGILSLTLLERAGYRGPFLPGFRPVSSAPGPGWVSRVDHLTLACTPGSSPTLLRWFHDCLGFCHLPLSPGEDPELGLEMTAGFGLGGLRLTALQAQPGSIVPTLVLAESLPGATTRQDQVEQFLARHKGPGLQHVGLYTPNIVEATEGVATAGGQFLAPPGAYYQQPGKERQIRAAGHEPHLLARQGILLDGDKGKFLLQVFTKSLFTEDTFFLELIQRQGATGFGQGNIRALWQSVQEQSARSQEA

SEQ ID NO: 8936 - protein, 455 aa, Homo sapiens
MAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKENCGIYFPEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKVVYFGDSMHSDIFPARHYSNWETVLILEELRGDEGTRSQRPEESEPLEKKGKYEGPKAKPLNTSSKKWGSFFIDSVLGLENTEDSLVYTWSCKRISTYSTIAIPSIEAIAELPLDYKFTRFSSSNSKTAGYYPNPPLVLSSDETLISK

SEQ ID NO: 8937 - protein, 195 aa, Homo sapiens
MAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKVRRLATSLLQDISTSFILI

SEQ ID NO: 8938 - protein, 111 aa, Homo sapiens
  MOD_RES (1)..(1): Any amino acid
XSHGTKMMTPEVLAEAYGKKEWKHFLSDTGMACRSGKYYFYDNYFDLPGALLCARVVDYLTKLNNGQKTFDFWKDIVAAIQHNYKMSAFKGKYCEEGPSNTCLLSYVCLVN

SEQ ID NO: 8939 - protein, 195 aa, Homo sapiens; identical to SEQ ID NO: 8937

SEQ ID NO: 8940 - protein, 520 aa, Homo sapiens
MRVESGSAQERGILLESLSTLLEKTTASHEGRAPGNRELTDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 8941 - protein, 461 aa, Homo sapiens
MRRLVHDLLPPEVCSLLNPAAIYANNEISLRDVEVYGFDYDYTLAQYADALHPEIFSTARDILIEHYKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 8942 - protein, 557 aa, Homo sapiens
MAGAGLRAAARRWLLCGGHGGPRAASSSPSCPGCGPPGPGAHCPGVPRSAPAQAPTSGADLSAHLWARYQDMRRLVHDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 8943 - protein, 845 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 8944 - protein, 362 aa, Homo sapiens
MDAQDCQAAASPEPPGPPARSCVAAWWDMVDRNLRYFPHSCSMLGRKIAALYDSFTSKSLKEHVFLPLIDMLIYFNFFKAPFLVDLKKPELKIPHTVNFYLRVEPGVMLGIWHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 8945 - protein, 285 aa, Homo sapiens
MDAQDCQAAASPEPPGPPARSCVAAWWDMVDRNLRHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 8946 - protein, 255 aa, Homo sapiens
MLGIWHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASINYPLLKIYRNIPGFLRTLMDALRKDKIIFPNDENVKFLSSPLLILHGEDDRTVPLEYGKKLYEIARNAYRNKERVKMVIFPPGFQHNLLCKSPTLLITVRDFLSKQWS

SEQ ID NO: 8947 - protein, 469 aa, Homo sapiens
MCVICFVKALVRVFKIYLTASYTYPFRGWPVAFRWDDVRAVGRSSSHRALTCAAAAAGVWLLRDETLGGDALGRPPRGARSQAQCLLQQLRELPGQLASYALAHSLGRWLVYPGSVSLMTRALLPLLQQGQERLVERYHGRRAKLVACDGNEIDTMFMDRRQHPGSHVHGPRLVICCEGNAGFYEMGCLSAPLEAGYSVLGWNHPGFGSSTGVPFPQHDANAMDVVVEYALHRLHFPPAHLVVYGWSVGGFTATWATMTYPELGALVLDATFDDLVPLALKVMPHSWKGLVVRTVREHFNLNVAEQLCCYPGPVLLLRRTQDDVVSTSGRLRPLSPGDVEGNRGNELLLRLLEHRYPVVMAREGRAVVTRWLRAGSLAQEAAFYARYRVDEDWCLALLRSYRARCEEELEGEEALGPHGPAFPWLVGQGLSSRRRRRLALFLARKHLKNVEATHFSPLEPEEFQLPWRL

SEQ ID NO: 8948 - protein, 342 aa, Homo sapiens
MADDLEQQSQGWLSSWLPTWRPTSMSQLKNVEARILQCLQNKFLARYVSLPNQNKIWTVTVSPEQNDRTPLVMVHGFGGGVGLWILNMDSLSARRTLHTFDLLGFGRSSRPAFPRDPEGAEDEFVTSIETWRETMGIPSMILLGHSLGGFLATSYSIKYPDRVKHLILVDPWGFPLRPTNPSEIRAPPAWVKAVASVLGRSNPLAVLRVAGPWGPGLVQRFRPDFKRKFADFFEDDTISEYIYHCNAQNPSGETAFKAMMESFGWARRPMLERIHLIRKDVPITMIYGSDTWIDTSTGKKVKMQRPDSYVRDMEIKGASHHVYADQPHIFNAVVEEICDSVD

SEQ ID NO: 8949 - protein, 439 aa, Homo sapiens
MLTGVTDGIFCCLLGTPPNAVGPLESVESSDGYTFVEVKPGRVLRVKHAGPAPAAAPPPPSSASSDAAQGDLSGLVRCQRRITVYRNGRLLVENLGRAPRADLLHGQNGSGEPPAALEVELADPAGSDGRLAPGSAGSGSGSGSGGRRRRARRPKRTIHIDCEKRITSCKGAQADVVLFFIHGVGGSLAIWKEQLDFFVRLGYEVVAPDLAGHGASSAPQVAAAYTFYALAEDMRAIFKRYAKKRNVLIGHSYGVSFCTFLAHEYPDLVHKVIMINGGGPTALEPSFCSIFNMPTCVLHCLSPCLAWSFLKAGFARQGAKEKQLLKEGNAFNVSSFVLRAMMSGQYWPEGDEVYHAELTVPVLLVHGMHDKFVPVEEDQRMAEILLLAFLKLIDEGSHMVMLECPETVNTLLHEFLLWEPEPSPKALPEPLPAPPEDKK

SEQ ID NO: 8950 - protein, 385 aa, Homo sapiens [sequence omitted]

SEQ ID NO: 8951 - protein, 616 aa, Homo sapiens
MELRTPGTKWSPQGIGSLRRVVWDYSTPEISLFSEEGLKGEQVKLTEALKNSQGLEKPLQVASATVSAGLWLLYPKPLFEDTPYILEPGEYPTSEAWGTSDPSVGSLKPMRLGCPSVEKPGEPRAVVYEAPGFQGRSWEVSRDIYNLQQPEDSQSPHLASVGSLRVLGGCWVGYEKEGFRGHQYLLEEGEYPDWSHWGGYDELLTSLRVIRTDFGDPAVVLFEAMDFEGHGVEVSKALPDVELVQHGPSTQAIHVLSGVWVAYQEVGFSGEQYVLEKGVYRNCEDWGAGNSTLASLQPVLQVGEHDLHFVSKIQLFSRPDFLGDHFSFEDDQAALPASFRPQSCRVHGGSWILFDETNFEGDQHILSEGEFPTLTAMGCLASTVLGSLQKVSLHFSEPSIFLYGLECFEGKEIELSREVRSLQAEGFNNHVLSVRIKGGIWVLCEHSDFRGRQWLVGSCEITNWLTYSGTQRVGSLYPIKQRRVYFRLWNAALGGFLAVPDHVEDMKAGRVVVADPQAGGSCIWYYEDGLLKNQMAPTMSLQVIGPPSPGSKVVLWAESRLPRQTWSISESGHICSQMFEGQILDVKGGRGYDRDHVVLWEPDEDRASQIWTIHVL

SEQ ID NO: 8952 - protein, 93 aa, Homo sapiens
MEEAGGPMARAKARVDGPVDPPAATVLPMVRSEHVTVPGQPPAPSTTRRKDVPSPGVDRVSPSPGGTPAPVPTGAEASTESQLVSDPTEGKTC

SEQ ID NO: 8953 - protein, 787 aa, Homo sapiens [sequence omitted]

SEQ ID NO: 8954 - protein, 407 aa, Homo sapiens
MEEAGGPMARAKARVVSATLTWRQRPPTQEEIKHGFHKVSLVSGAQMEAPQKEMFEFSRREEVEVNGFATQEEETVNCQGPRDTAGSKNFQSHGPIFSKKYIPPPKEKRPEGRLKEAVDQSDGSRQAPRTEPPCVGAMARTELLVPLPGPREPSPHPGVGLTSGSSRSLEEYRVTRTVRTTTVVGGHVDRRMSSSVTVRPVSSGEALPRGRQVSRMVPPVVVGSPPGSPSRSQAVKVLSNLVPAGHSPPASHLPRPTAGGPRSTGLGSTVGAALRQLPETGTAELKDSSALASTGIPASAHLPKNQDAPAACPDRDQGRAPDARACELWQVLGAPSSTELPLQTSQGQASVPSSPRLETHVPSPGLTHPAKQPVVPTHPGARLTPLVLPPKKRTGPWTPLLPPSCPW

SEQ ID NO: 8955 - protein, 375 aa, Homo sapiens
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 8956 - protein, 375 aa, Homo sapiens; identical to SEQ ID NO: 8955

SEQ ID NO: 8957 - protein, 341 aa, Homo sapiens
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPASLWAVTLPTPPQSPIHPGTWTPRFSVIPWSSWSLSWFGQSSGQHLEESVIPGTAPCPPQRKRGCGAARRGPRSWTCGCWGQFEHYRRACRRCRRGCRAWRACPGPLSRGRSPGPVLGHGPLGSRGPRCSSSSCGPSSSSGSSECFGPKRGDCQWRGLCSQLRLSCCALSLPRV

SEQ ID NO: 8958 - protein, 268 aa, Homo sapiens
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELSSGQHLEESVIPGTAPCPPQRKRGCGAARRGPRSWTCGCWGQFEHYRRACRRCRRGCRAWRACPGPLSSLTLSVRLE

SEQ ID NO: 8959 - protein, 305 aa, Homo sapiens
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELVWTEQRAASGGKRDPRNSPVPPTKKEGLRGSPPGPQELDVWLLGTVRALQESMQEVQARVQSLESMPRPPEQRPQPRPSARPWPLGLPGPALLFFLLWPFVVQWLFRMFRTQKR

SEQ ID NO: 8960 - protein, 341 aa, Homo sapiens; identical to SEQ ID NO: 8957

SEQ ID NO: 8961 - protein, 88 aa, Homo sapiens
MALQADFDRAAEDVRKLKARPDDGELKELYGLYKQAIVGDINIACPGMLDLKGKAKWEAWNLKKGLSTEDATSAYISKAKELIEKYGI

SEQ ID NO: 8962 - protein, 1059 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQAFGAAGLSSDYPLAQFFTWARALRFADGPDEVHRATVAKLELKHRI

SEQ ID NO: 8963 - protein, 492 aa, Homo sapiens
MLEYLSLTFLISVKIQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGCFLPSFSL

SEQ ID NO: 8964 - protein, 890 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGCFLPSFSL

SEQ ID NO: 8965 - protein, 1090 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKRQGFAVLPKLVSNSWAQAIYPPYPPKVVRLQVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQAFGAAGLSSDYPLAQFFTWARALRFADGPDEVHRATVAKLELKHRI

SEQ ID NO: 8966 - protein, 96 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEI

SEQ ID NO: 8967 - protein, 1103 aa, Homo sapiens
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 8968 - protein, 665 aa, Homo sapiens
MASASQGADDDGSRRKPRLAASLQISPQPRPWRPLPAQAQSAWGPAPAPATYRAEGGWPQVSVLRDSGPGAGAGVGELGAARAWENLGEQMGKAPRVPVPPAGLSLPLKDPPASQAVSLLTEYAASLGIFLLFREDQPPGKVFKYRAPGGEELKAMCLWQVEVLRAFLLRTGWRGLWRGDLDLGPDSSWANRLPFLLICEMESRIPAVEELGPCFPFSVSAELDGVVCPAGTANSKTEAKQQAALSALCYIRSQLENPESPQTSSRPPLAPLSVENILTHEQRCAALVSAGFDLLLDERSPYWACKGTVAGVILERGWAVSAPSCTEIPRARGHVKEIYKLVALGTGSSCCAGWLEFSGQQLHDCHGLVIARRALLRFLFRQLLLATQGGPKGKEQSVLAPQPGPGPPFTLKPRVFLHLYISNTPKGAARDIYLPPTSEGGLPHSPPMRLQAHVLGQLKPVCYVAPSLCDTHVGCLSASDKLARWAVLGLGGALLAHLVSPLYSTSLILADSCHDPPTLSRAIHTRPCLDSVLGPCLPPPYVRTALHLFAGPPVAPSEPTPDTCRGLSLNWSLGDPGIEVVDVATGRVKANAALGPPSRLCKASFLRAFHQAARAVGKPYLLALKTYEAAKAGPYQEARRQLSLLLDQQGLGAWPSKPLVGKFRN

SEQ ID NO: 8969 - protein, 583 aa, Homo sapiens
MASASQGADDDGSRRKPRLAASLQISPQPRPWRPLPAQAQSAWGPAPAPATYRAEGGWPQVSVLRDSGPGAGAGVGELGAARAWENLGEQMGKAPRVPVPPAGLSLPLKDPPASQAVSLLTEYAASLGIFLLFREDQPPGPCFPFSVSAELDGVVCPAGTANSKTEAKQQAALSALCYIRSQLENPESPQTSSRPPLAPLSVENILTHEQRCAALVSAGFDLLLDERSPYWACKGTVAGVILEREIPRARGHVKEIYKLVALGTGSSCCAGWLEFSGQQLHDCHGLVIARRALLRFLFRQLLLATQGGPKGKEQSVLAPQPGPGPPFTLKPRVFLHLYISNTPKGAARDIYLPPTSEGGLPHSPPMRLQAHVLGQLKPVCYVAPSLCDTHVGCLSASDKLARWAVLGLGGALLAHLVSPLYSTSLILADSCHDPPTLSRAIHTRPCLDSVLGPCLPPPYVRTALHLFAGPPVAPSEPTPDTCRGLSLNWSLGDPGIEVVDVATGRVKANAALGPPSRLCKASFLRAFHQAARAVGKPYLLALKTYEAAKAGPYQEARRQLSLLLDQQGLGAWPSKPLVGKFRN

SEQ ID NO: 8970 - protein, 191 aa, Homo sapiens
MEAKAAPKPAASGACSVSAEETEKWMEEAMHMAKEALENTEVPVGCLMVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 8971 - protein, 36 aa, Homo sapiens
MEAKAAPKPAASGACSVSAEETEKWMEEAMHMEIFL

SEQ ID NO: 8972 - protein, 144 aa, Homo sapiens
MVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 8973 - protein, 351 aa, Homo sapiens
MEPAPGLVEQPKCLEAGSPEPEPAPWQALPVLSEKQSGDVELVLAYAAPVLDKRQTSRLLKEVSALHPLPAQPHLKRVRPSRDAGSPHALEMLLCLAGPASGPRSLAELLPRPAVDPRGLGQPFLVPVPARPPLTRGQFEEARAHWPTSFHEDKQVTSALAGRLFSTQERAAMQSHMERAVWAARRAAARGLRAVGAVVVDPASDRVLATGHDCSCADNPLLHAVMVCVDLVARGQGRGTYDFRPFPACSFAPAAAPQAVRAGAVRKLDADEDGLPYLCTGYDLYVTREPCAMCAMALVHARILRVFYGAPSPDGALGTRFRIHARPDLNHRFQVFRGVLEEQCRWLDPDT

SEQ ID NO: 8974 - protein, 53 aa, Homo sapiens
MEPAPGLVEQPKCLEAGSPEPEPAPWQALPVLSEKQSGDVELVLAYAAPVLDK

SEQ ID NO: 8975 - protein, 267 aa, Homo sapiens
MIEAEEQQPCKTDFYSELPKVELHAHLNGSISSHTMKKLIAQKPDLKIHDQMTVIDKGKKRTLEECFQMFQTIHQLTSSPEDILMVTKDVIKEFADDGVKYLELRSTPRRENATGMTKKTYVESILEGIKQSKQENLDIDVRYLIAVDRRGGPLVAKETVKLAEEFFLSTEGTVLGLDLSGDPTVGQAKDFLEPLLEAKKAGLKLALHLSEIPNQKKETQILLDLLPDRIGHGTFLNSGEGGSLDLVDFVRQHRIPLGKAWSFRSSR

SEQ ID NO: 8976 - protein, 355 aa, Homo sapiens
MIEAEEQQPCKTDFYSELPKVELHAHLNGSISSHTMKKLIAQKPDLKIHDQMTVIDKGKKRTLEECFQMFQTIHQLTSSPEDILMVTKDVIKEFADDGVKYLELRSTPRRENATGMTKKTYVESILEGIKQSKQENLDIDVRYLIAVDRRGGPLVAKETVKLAEEFFLSTEGTVLGLDLSGDPTVGQAKDFLEPLLEAKKAGLKLALHLSEIPNQKKETQILLDLLPDRIGHGTFLNSGEGGSLDLVDFVRQHRIPLELCLTSNVKSQTVPSYDQHHFGFWYSIAHPSVICTDDKGVFATHLSQEYQLAAETFNLTQSQVWDLSYESINYIFASDSTRSELRKKWNHLKPRVLHI

SEQ ID NO: 8977 - protein, 328 aa, Homo sapiens
MIEAEEQQPCKTDFYSELPKVELHAHLNGSISSHTMKKLIAQKPDLKIHDQMTVIDKGKKRTLEECFQMFQTIHQLTSSPEDILMVTKDVIKEFADDGVKYLELRSTPRRENATGMTKKTYVESILEGIKQSKQENLDIDVRYLIAVDRRGGPLVAKETVKLAEEFFLSTEGTVLGLDLSGDPTIPNQKKETQILLDLLPDRIGHGTFLNSGEGGSLDLVDFVRQHRIPLELCLTSNVKSQTVPSYDQHHFGFWYSIAHPSVICTDDKGVFATHLSQEYQLAAETFNLTQSQVWDLSYESINYIFASDSTRSELRKKWNHLKPRVLHI

SEQ ID NO: 8978 - protein, 611 aa, Homo sapiens
MSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 8979 - protein, 509 aa, Homo sapiens
MEKWDGNEGTSAFHMPEWMQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 8980 - protein, 610 aa, Homo sapiens
MSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 8981 - protein, 75 aa, Homo sapiens
MEKWDGNEGTSAFHMPEWMQIQFADQKQEFNKRPTKIGRRSLSRSISQSSTDSYSSAASYTDSSDDETSPRDKQQ

SEQ ID NO: 8982 - protein, 508 aa, Homo sapiens
MEKWDGNEGTSAFHMPEWMIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 8983 - protein, 530 aa, Homo sapiens
MYFLCFFCLFVSGRKWSRQFLLSFWCTVCSAHQGTIFLSLKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 8984 - protein, 508 aa, Homo sapiens
MLGSKKKYIVNGNSGIKAQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 8985 - protein, 421 aa, Homo sapiens
MTSQEKTEEYPFADIFDEDETERNFLLSKPVCFVVFGKPGVGKTTLARYITQAWKCIRVEALPILEEQIAAETESGVMLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMIVMDRLKYLNLKRAAILTKLQGAEEEINDTMENDELFRTLASYKLIAPRYRWQRSKWGRTCPVNLKDGNIYSGLPDYSVSFLGKIYCLSSEEALKPFLLNPRPYLLPPMPGPPCKVFILGPQYSGKTTLCNMLAENYKGKVTN

SEQ ID NO: 8986 - protein, 362 aa, Homo sapiens
MKERKRHLGDTKHFCPVVLKENFILQPGNTEEAAKYREKIYYFSSAEAKEKFLEHPEDYVAHEEPLKAPPLRICLVGPQGSGKTMCGRQLAEKLNIFHIQFEEVLQEKLLLKTEKKVGPEFEEDSENEQAAKQELEELAIQANVKVEEENTKKQLPEVQLTEEEEVIKSSLMENEPLPPEILEVILSEWWLKEPIRSTGFILDGFPRYPEEAQFLGDRGFFPDAAVFIQVDDQDIFDRLLPAQIEKWKLKQKKKLERKKLIKDMKAKIRVDTIAKRRAELILERDKKRREPNKEKRKRGISENTTCYKCNHMSPWCEYAGLPYRGLLILYSATATATAGTKHCRSGAKVIVALSKQNIHNQK

SEQ ID NO: 8987 - protein, 736 aa, Homo sapiens
MTSQEKTEEYPFADIFDEDETERNFLLSKPVCFVVFGKPGVGKTTLARYITQAWKCIRVEALPILEEQIAAETESGVMLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMIVMDRLKYLNLKRAAILTKLQGAEEEINDTMENDELFRTLASYKLIAPRYRWQRSKWGRTCPVNLKDGNIYSGLPDYSVSFLGKIYCLSSEEALKPFLLNPRPYLLPPMPGPPCKVFILGPQYSGKTTLCNMLAENYKGKVVDYAQLVQPRFDKARETLVENTIAEATAAAIKVVKEKLLRELQARKQAETALREFQRQYEKMEFGVFPMEATHSSIDEEGYIQGSQRDRGSSLVDTEEAKTKSENVLHDQAAKVDKDDGKETGETFTFKRHSQDASQDVKLYSDTAPTEDLIEEVTADHPEVVTMIEETIKMSQDINFEQPYEKHAEILQEVLGEVMEENKDRFPGAPKYGGWIVDNCPIVKELWMALIKKGIIPDLVIYLSDTENNGKCLFNRIYLQKKSEIDSKILERLLEELQKKKKEEEEARKATEEELRLEEENRRLLELMKVKAKGKHRLL

SEQ ID NO: 8988 - protein, 1911 aa, Homo sapiens [sequence omitted]

SEQ ID NO: 8989 - protein, 227 aa, Homo sapiens
MLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMIVMDRLKYLNLKRAAILTKLQGAEEE

SEQ ID NO: 8990 - protein, 357 aa, Homo sapiens
MEKYVAAMVLSAAGDALGYYNGKWEFLQDGEKIHRQLAQLGGLDALDVGRWRVSDDTVMHLATAEALVEAGKAPKLTQLYYLLAKHYQDCMEDMDGRAPGGASVHNAMQLKPGKPNGWRIPFNSHEGGCGAAMRAMCIGLRFPHHSQLDTLIQVSIESGRMTHHHPTGYLGALASALFTAYAVNSRPPLQWGKGLMELLPEAKKYIVQSGYFVEENLQHWSYFQTKWENYLKLRGILDGESAPTFPESFGVKERDQFYTSLSYSGWGGSSGHDAPMIAYDAVLAAGDSWKELAHRAFFHGGDSDSTAAIAGCWWGVMYGFKGVSPSNYEKLEYRNRLEETARALYSLGSKEDTVISL

SEQ ID NO: 8991 - protein, 357 aa, Homo sapiens; identical to SEQ ID NO: 8990

SEQ ID NO: 8992 - protein, 357 aa, Homo sapiens; identical to SEQ ID NO: 8990

SEQ ID NO: 8993 - protein, 357 aa, Homo sapiens; identical to SEQ ID NO: 8990

SEQ ID NO: 8994 - protein, 125 aa, Homo sapiens
MEKYVAAMVLSAAGDALGYYNGKWEFLQDGEKIHRQLAQLGGLDALDVGRWRVSDDTVMHLATAEALVEAGKAPKLTQLYYLLAKHYQDCMEDMDGRAPGGASVHNAMQLKPGKPNGWRIPFNSH

SEQ ID NO: 8995 - protein, 244 aa, Homo sapiens
MAPRPLGPLVLALGGAAAVLGSVLFILWKTYFGRGRERRWDRGEAWWGAEAARLPEWDEWDPEDEEDEEPALEELEQREVLVLGLDGAGKSTFLRVLSGKPPLEGHIPTWGFNSVRLPTKDFEVDLLEIGGSQNLRFYWKEFVSEVDVLVFVVDSADRLRLPWARQELHKLLDKDPDLPVVVVANKQDLSEAMSMGELQRELGLQAIDNQREVFLLAASIAPAGPTFEEPGTVHIWKLLLELLS

SEQ ID NO: 8996 - protein, 256 aa, Homo sapiens
MFRLLSSCCSCLRTTEETRRNVTIPIIGLNNSGKTVLVEAFQKLLPSKTDHCMKSELTTLLLDEYELSIYDLNGDLKGREAWPNYYAQAHGLVFVLDSSDIRRMQEVKIILTHLLSDKRVAGKPILILANKQDKKKALMPCDIIDYLLLKKLVKENKCPCRVEPCSAIRNLERRNHQPIVEGLRWLLAVIDTCQLPPTSSISISKNNTGSGERCSSHSFSTRTGMSKEKRQHLEQCSIEAKPLKSILQPSNQSYTH

SEQ ID NO: 8997 - protein, 290 aa, Homo sapiens
MFRLLSSCCSCLRTTEETRRNVTIPIIGLNNSGKTVLVEAFQKLLPSKTDHCMKSELTTLLLDEYELSIYDLNGDLKGREAWPNYYAQAHGLVFVLDSSDIRRMQEVKIILTHLLSDKRVAGKPILILANKQDKKKALMPCDIIDYLLLKKLVKENKCPCRVEPCSAIRNLERRNHQPIVEGLRWLLAVIDTCQLPPTSSISISKNNTGSGERCSSHSFSTRTGMSKEKRQHLEQCSIEAKPLKSILQKEGTRLWSKKNMSVTFALDEPMKEGECSRRMRAQNTTKLCYN

SEQ ID NO: 8998 - protein, 197 aa, Homo sapiens
MRVAGGRALSRGAELRVPGGAKHGMCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 8999 - protein, 179 aa, Homo sapiens
MGQLIAKLMSIFGNQEHTVIIVGLDNEGKTTILYRFLTNEVVHMCPTIGSNVEEIILPKTHFFMWDIVRPEALSFIWNTYYSNTEFIILVIDSTDRDRLLTTREELYKMLAHEALQDASVLIFANKQDVKDSMRMVEISHFLTLSTIKDHSWHIQGCCALTREGLPARLQWMESQAAAN

SEQ ID NO: 9000 - protein, 179 aa, Homo sapiens; identical to SEQ ID NO: 8999

SEQ ID NO: 9001 - protein, 1311 aa, Homo sapiens
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILREMTHSWPTPLTSMHTAGHSEQSTFSIPGQESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 9002 - protein, 1276 aa, Homo sapiens
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 9003 - protein, 443 aa, Homo sapiens
MTRPRKHAETLGGGKLCDLFCGRPGQVSSSRGRQGIPDMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEIPKEHPGHPSGPRGSGGSEVTGTPQGGPQEAPNEELCELAPQTYLNGHYGDAAAQNKPDQVAMRLSSNSGEDPNGTPRRQDCAEMTAPSPSCAFCRRLLEWKQNVEKKGHGRINCGRFSIVLHEKAPHSDSTPNSDTGHSFCSDSGTEMQSNKCQDCGTKIPTSRRACRKEPTKEFHYRYNTPGQNYSNHSKRGAFVQPHSLDESKNSSPCKYISCMTPSISTT

SEQ ID NO: 9004 - protein, 722 aa, Homo sapiens
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEAPNEELCELAPQTYLNGHYGDAAAQNKPDQVAMRLSSNSGEDPNGTPRRQDCAEMTAPSPSCAFCRRLLEWKQNVEKKGHGRINCGRFSIVLHEKAPHSDSTPNSDTGHSFCSDSGTEMQSNKCQDCGTKIPTSRRACRKEPTKEFHYRYNTPGQNYSNHSKRGAFVQPHSLDESKNSSPCLVHSPDTSKSSPTSGWQEAELGLENMKSQ

SEQ ID NO: 9005 - protein, 761 aa, Homo sapiens
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEIPKEHPGHPSGPRGSGGSEVTGTPQGGPQEAPNEELCELAPQTYLNGHYGDAAAQNKPDQVAMRLSSNSGEDPNGTPRRQDCAEMTAPSPSCAFCRRLLEWKQNVEKKGHGRINCGRFSIVLHEKAPHSDSTPNSDTGHSFCSDSGTEMQSNKCQDCGTKIPTSRRACRKEPTKEFHYRYNTPGQNYSNHSKRGAFVQPHSLDESKNSSPSLASPFCCPGLVHSPDTSKSSPTSGWQEAELGLENMKSQ

SEQ ID NO: 9006 - protein, 836 aa, Homo sapiens
MDEADFSEHTTYKQEDLPYDGDLSQIKIGNDYSFTSKKDGLEVLNQIIFIADDPQEKAMHSETCGNTAVTIPLGKITENAANKKDEKEKQCTAALHIPANEGDASKSSISDILLHHLSKEPFLRGQGIDCETLPEISNADSFEEEAIIKSIISCYNKNSWPKEQTPELTDQLNPKRDGENSNKPGSATTTEENTSDLEGPVAAGDSSHQENVNVLTKTKGPGDKQKSYQGQSPQKQQTEKANSGNTFKYGQGQVHYQLPDFSKIAPKVKIPKNKIINKPLAIAKQASFSSKSRDKPTLVQDSLETTPESNCVEKQHQEQKGKITEPSQQIQMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLEDVKEKMDESKYTSAPSLPVSSPVTLDDLASTFSSLSNEIPKEHPGHPSGPRGSGGSEVTGTPQGGPQEAPNEELCELAPQTYLNGHYGDAAAQNKPDQVAMRLSSNSGEDPNGTPRRQDCAEMTAPSPSCAFCRRLLEWKQNVEKKGHGRINCGRFSIVLHEKAPHSDSTPNSDTGHSFCSDSGTEMQSNKCQDCGTKIPTSRRACRKEPTKEFHYRYNTPGQNYSNHSKRGAFVQPHSLDESKNSSPSFLKPKRICSQRVNSKSFKGEHEPTPGKKKLQAFMTYSSDPATPSPHFYSCRISGSKSLCDFDSTEEIKSEILNSALDHALRTATILKETTDQMIKTIAEDLAKAQRWRNRLKY

SEQ ID NO: 9007 - protein, 344 aa, Homo sapiens
MVLQMEPQVNSTNNFHQGPLDQPVGPLTGLKSSLLKDTTSAGPLLRPYPASLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 9008 - protein, 323 aa, Homo sapiens
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 9009 - protein, 323 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 9010 - protein, 323 aa, Homo sapiens
MDSKHQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 9011 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKQTPALIALRYQLQRGVVVLAKSYNEQRIRENIQVFEFQLTSEDMKVLDGLNRNYRYVVMDFLMDHPDYPFSDEY

SEQ ID NO: 9012 - protein, 323 aa, Homo sapiens; identical to SEQ ID NO: 9011

SEQ ID NO: 9013 - protein, 316 aa, Homo sapiens
MATFVELSTKAKMPIVGLGTWRSLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 9014 - protein, 27 aa, Homo sapiens
NPNWKRIRLNDGPFMPVLGFGTYAPDH

SEQ ID NO: 9015 - protein, 153 aa, Homo sapiens
MHLTTAPRWKRHCVPATSCTRRASSWSLASPTMPPGKWPRSVPSARATAGSCPLCTSFWKEHHFEGIALVEKALQAAYGASAPSMTSAALRWMYHHSQLQGAHGDAVILGMSSLEQLEQNLAAAEEGPLEPAVVDAFNQAWHLFAHECPNYFI

SEQ ID NO: 9016 - protein, 300 aa, Homo sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTR

SEQ ID NO: 9017 - protein, 310 aa, Homo sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 9018 - protein, 333 aa, Homo sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTSSLPRSEESRY

SEQ ID NO: 9019 - protein, 409 aa, Homo sapiens
MWLTWPFCFLTITLREEGVCHLESVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 9020 - protein, 398 aa, Homo sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHPPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 9021 - protein, 323 aa, Homo sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTR

SEQ ID NO: 9022 - protein, 421 aa, Homo sapiens
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 9023 - protein, 409 aa, Homo sapiens; identical to SEQ ID NO: 9019

SEQ ID NO: 9024 - protein, 333 aa, Homo sapiens; identical to SEQ ID NO: 9018

SEQ ID NO: 9025 - protein, 300 aa, Homo sapiens; identical to SEQ ID NO: 9016

SEQ ID NO: 9026 - protein, 421 aa, Homo sapiens; identical to SEQ ID NO: 9022

SEQ ID NO: 9027 - protein, 323 aa, Homo sapiens; identical to SEQ ID NO: 9021

SEQ ID NO: 9028 - protein, 310 aa, Homo sapiens; identical to SEQ ID NO: 9017

SEQ ID NO: 9029 - protein, 323 aa, Homo sapiens; identical to SEQ ID NO: 9021

SEQ ID NO: 9030 - protein, 409 aa, Homo sapiens; identical to SEQ ID NO: 9019

SEQ ID NO: 9031 - protein, 300 aa, Homo sapiens; identical to SEQ ID NO: 9016

SEQ ID NO: 9032 - protein, 300 aa, Homo sapiens; identical to SEQ ID NO: 9016

SEQ ID NO: 9033 - protein, 323 aa, Homo sapiens; identical to SEQ ID NO: 9021

SEQ ID NO: 9034 - protein, 421 aa, Homo sapiens; identical to SEQ ID NO: 9022

SEQ ID NO: 9035 - protein, 300 aa, Homo sapiens; identical to SEQ ID NO: 9016

SEQ ID NO: 9036 - protein, 323 aa, Homo sapiens; identical to SEQ ID NO: 9021

SEQ ID NO: 9037 - protein, 310 aa, Homo sapiens; identical to SEQ ID NO: 9017

SEQ ID NO: 9038 - protein, 409 aa, Homo sapiens; identical to SEQ ID NO: 9019

SEQ ID NO: 9039 - protein, 333 aa, Homo sapiens; identical to SEQ ID NO: 9018

SEQ ID NO: 9040 - protein, 310 aa, Homo sapiens; identical to SEQ ID NO: 9017

SEQ ID NO: 9041 - protein, 421 aa, Homo sapiens; identical to SEQ ID NO: 9022

SEQ ID NO: 9042 - protein, 409 aa, Homo sapiens; identical to SEQ ID NO: 9019

SEQ ID NO: 9043 - protein, 421 aa, Homo sapiens; identical to SEQ ID NO: 9022

SEQ ID NO: 9044 - protein, 300 aa, Homo sapiens; identical to SEQ ID NO: 9016

SEQ ID NO: 9045 - protein, 310 aa, Homo sapiens; identical to SEQ ID NO: 9017

SEQ ID NO: 9046 - protein, 421 aa, Homo sapiens; identical to SEQ ID NO: 9022

SEQ ID NO: 9047 - protein, 310 aa, Homo sapiens; identical to SEQ ID NO: 9017

SEQ ID NO: 9048 - protein, 323 aa, Homo sapiens; identical to SEQ ID NO: 9021

SEQ ID NO: 9049 - protein, 409 aa, Homo sapiens; identical to SEQ ID NO: 9019

SEQ ID NO: 9050 - protein, 300 aa, Homo sapiens; identical to SEQ ID NO: 9016

SEQ ID NO: 9051 - protein, 333 aa, Homo sapiens; identical to SEQ ID NO: 9018

SEQ ID NO: 9052 - protein, 333 aa, Homo sapiens; identical to SEQ ID NO: 9018

SEQ ID NO: 9053 - protein, 421 aa, Homo sapiens; identical to SEQ ID NO: 9022

SEQ ID NO: 9054 - protein, 310 aa, Homo sapiens; identical to SEQ ID NO: 9017

SEQ ID NO: 9055 - protein, 333 aa, Homo sapiens; identical to SEQ ID NO: 9018

SEQ ID NO: 9056 - protein, 333 aa, Homo sapiens; identical to SEQ ID NO: 9018

SEQ ID NO: 9057 - protein, 323 aa, Homo sapiens; identical to SEQ ID NO: 9021

SEQ ID NO: 9058 - protein, 409 aa, Homo sapiens; identical to SEQ ID NO: 9019

SEQ ID NO: 9059 - protein, 398 aa, Homo sapiens; identical to SEQ ID NO: 9020

SEQ ID NO: 9060 - protein, 398 aa, Homo sapiens; identical to SEQ ID NO: 9020

SEQ ID NO: 9061 - protein, 398 aa, Homo sapiens; identical to SEQ ID NO: 9020

SEQ ID NO: 9062 - protein, 398 aa, Homo sapiens; identical to SEQ ID NO: 9020

SEQ ID NO: 9063 - protein, 398 aa, Homo sapiens; identical to SEQ ID NO: 9020

SEQ ID NO: 9064 - protein, 398 aa, Homo sapiens; identical to SEQ ID NO: 9020

SEQ ID NO: 9065 - protein, 205 aa, Homo sapiens
MSFATKFSDYFLLIEDNVFFAPNFVTHIHSRVTTMKSNSWVLMEFSNMGFLGKLFHSRDLPLLAHFLLLFYKEKPLDSLISHFHTLLVQESPILCRPFLFYCRVSYTAFDHKQKATALQKKNADGPNNPPGAVFTDMQVSDVHFPWEAYTLDESFFWTHNISIGNHLTVILNHPANLSRVQVMTGSIVEWEVRPGEGAGGAGLPT

SEQ ID NO: 9066 - protein, 205 aa, Homo sapiens; identical to SEQ ID NO: 9065

SEQ ID NO: 9067 - protein, 2170 aa, Homo sapiens
MKDSEGPQRPPLCFLSTLLSQKVPEKSDAVLRCIISGQPKPEVTWYKNGQAIDGSGIISNYEFFENQYIHVLHLSCCTKNDAAVYQISAKNSFGMICCSASVEVECSSENPQLSPNLEDDRDRGWKHETGTHEEERANQIDEKEHPYKEEESISPGTPRSADSSPSKSNHSLSLQSLGNLDISVSSSENPLGVKGTRHTGEAYDPSNTEEIANGLLFLNSSHIYEKQDRCCHKTVHSMASKFTDGDLNNDGPHDEGLRSSQQNPKVQKYISFSLPLSEATAHIYPGDSAVANKQPSPQLSSEDSDSDYELCPEITLTYTEEFSDDDLEYLECSDVMTDYSNAVWQRNLLGTEHVFLLESDDEEMEFGEHCLGGCEHFLSGMGCGSRVSGDAGPMVATAGFCGHHSQPQEVGVRSSRVSKHGPSSPQTGMTLILGPHQDGTSSVTEQGRYKLPTAPEAAENDYPGIQGETRDSHQAREEFASDNLLNMDESVRETEMKLLSGESENSGMSQCWETAADKRVGGKDLWSKRGSRKSARVRQPGMKGNPKKPNANLRESTTEGTLHLCSAKESAEPPLTQSDKRETSHTTAAATGRSSHADARECAISTQAEQEAKTLQTSTDSVSKEGNTNCKGEGMQVNTLFETSQVPDWSDPPQVQVQETVRETISCSQMPAFSEPAGEESPFTGTTTISFSNLGGVHKENASLAQHSEVKPCTCGPQHEEKQDRDGNIPDNFREDLKYEQSISEANDETMSPGVFSRHLPKDARADFREPVAVSVASPEPTDTALTLENVCDEPRDREAVCAMECFEAGDQGTCFDTIDSLVGRPVDKYSPQEICSVDTELAEGQNKVSDLCSSNDKTLEVFFQTQVSETSVSTCKSSKDGNSVMSPLFTSTFTLNISHTASEGATGENLAKVENSTYPLASTVHAGQEQPSPSNSGGLDETQLLSSENNPLVQFKEGGDKSPSPSAADTTATPASYSSIVSFPWEKPTTLTANNECFQATRETEDTSTVTIATEVHPAKYLAVSIPEDKHAGGTEERFPRASHEKVSQFPSQVQLDHILSGATIKSTKELLCRAPSVPGVPHHVLQLPEGEGFCSNSPLQVDNLSGDKSQTVDRADFRSYEENFQERGSETKQGVQQQSLSQQGSLSAPDFQQSLPTTSAAQEERNLVPTAHSPASSREGAGQRSGWGTRVSVVAETAGEEDSQALSNVPSLSDILLEESKEYRPGNWEAGNKLKIITLEASASEIWPPRQLTNSESKASDGGLIIPDKVWAVPDSLKADAVVPELAPSEIAALAHSPEDAESALADSRESHKGEEPTISVHWRSLSSRGFSQPRLLESSVDPVDEKELSVTDSLSAASETGGKENVNNVSQDQEEKQLKMDHTAFFKKFLTCPKILESSVDPIDEISVIEYTRAGKPEPSETTPQGAREGGQSNDGNMGHEAEIQPAILQVPCLQGTILSENRISRSQEGSMKQEAEQIQPEEAKTAIWQVLQPSEGGERIPSGCSIGQIQESSDGSLGEAEQSKKDKAELISPTSPLSSCLPIMTHASLGVDTHNSTGQIHDVPENDIVEPRKRQYVFPVSQKRGTIENERGKPLPSSPDLTRFPCTSSPEGNVTDFLISHKMEEPKIEVLQIGETKPPSSSSSSAKTLAFISGERELEKAPKLLQDPCQKGTLGCAKKSREREKSLEARAGKSPGTLTAVTGSEEVKRKPEAPGSGHLAEGVKKKILSRVAALRLKLEEKENIRKNSAFLKKMPKLETSLSHTEEKQDPKKPSCKREGRAPVLLKKIQAEMFPEHSGNVKLSCQFAEIHEDSTICWTKDSKSIAQVQRSAGDNSTVSFAIVQASPKDQGLYYCCIKNSYGKVTAEFNLTAEVLKQLSSRQDTKGCEEIEFSQLIFKEDFLHDSYFGGRLRGQIATEELHFGEGVHRKAFRSTVMHGLMPVFKPGHACVLKVHNAIAYGTRNNDELIQRNYKLAAQECYVQNTARYYAKIYAAEAQPLEGFGEVPEIIPIFLIHRPENNIPYATVEEELIGEFVKYSIRDGKEINFLRRESEAGQKCCTFQHWVYQKTSGCLLVTDMQGVGMKLTDVGIATLAKGYKGFKGNCSMTFIDQFKALHQCNKYCKMLGLKSLQNNNQKQKQPSIGKSKVQTNSMTIKKAGPETPGEKKT

SEQ ID NO: 9068 - protein, 409 aa, Homo sapiens
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGTKTLSGSIAPMDVCVRHFLQATGCSMESALEAASLHPAQLLGLEKSKGTLDFGADADFVVLDDSLHVQATYISGELVWQADAARQ

SEQ ID NO: 9069 - protein, 439 aa, Homo sapiens
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGCSMESALEAASLHPAQLLGLEKSKGTLDFGADADFVVLDDSLHVQATYISGELVWQADAARQ

SEQ ID NO: 9070 - protein, 594 aa, Homo sapiens
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGCSMESALEAASLHPAQLLGLEKSKGTLDFGADADFVVLDDSLHVQATYISGPVLAGCGDPAWCWRAVWEAPVCPAHPISVILPSSVSPWPWHTPMWQTRAVRLPEQLRGGWASGALLALRTATVGSDVRDWCSPTSGVIVLTFSPFEFWGGWLPSPLLTGAVLGTGGTRLALPLFSSLCCKAQLRKCLQVQRDRMVWAPPVGREQPGKNHLPGQGLA

SEQ ID NO: 9071 - protein, 310 aa, Homo sapiens
MGKRRCVPPLEPKLAAGCCGVKKPKLSGSGTHSHGNQSTTVPGSSSGPLQNHQHVDSSSGRENVSDLTLGPGNSPITRMNPASGALSPLPRPNGTANTTKNLVVTAEMCCYCFDVLYCHLYGFPQPRLPRFTNDPYPLFVTWKTGRDKRLRGCIGTFSAMNLHSGLREYTLTSALKDSRFPPLTREELPKLFCSVSLLTNFEDASDYLDWEVGVHGIRIEFINEKGVKRTATYLPEVAKEQDWDQIQTIDSLLRKGGFKAPITSEFRKTIKLTRYRSEKVTISYAEYIASRQHCFQNGTLHAPPLYNHYS

SEQ ID NO: 9072 - protein, 310 aa, Homo sapiens; identical to SEQ ID NO: 9071

SEQ ID NO: 9073 - protein, 575 aa, Homo sapiens
MDFPTISRSPSGPPAMDLEGPRDILVPSEDLTPDSQWDPMPGGPGSLSRMELDESSLQELVQQFEALPGDLVGPSPGGAPCPLHIATGHGLASQEIADAHGLLSAEAGRDDLLGLLHCEECPPSQTGPEEPLEPAPRLLQPPEDPDEDSDSPEWVEGASAEQEGSRSSSSSPEPWLETVPLVTPEEPPAGAQSPETLASYPAPQEVPGPCDHEDLLDGVIFGARYLGSTQLVSERNPPTSTRMAQAREAMDRVKAPDGETQPMTEVDLFVSTKRIKVLTADSQEAMMDHALHTISYTADIGCVLVLMARRRLARRPAPQDHGRRLYKMLCHVFYAEDAQLIAQAIGQAFAAAYSQFLRESGIDPSQVGVHPSPGACHLHNGDLDHFSNSDNCREVHLEKRRGEGLGVALVESGWGSLLPTAVIANLLHGGPAERSGALSIGDRLTAINGTSLVGLPLAACQAAVRETKSQTSVTLSIVHCPPVTTAIIHRPHAREQLGFCVEDGIICSLLRGGIAERGGIRVGHRIIEINGQSVVATPHARIIELLTEAYGEVHIKTMPAATYRLLTGQEQPVYL

SEQ ID NO: 9074 - protein, 670 aa, Homo sapiens
MIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQDLMQQSSELYLHCHPDILNWNYRFVNLMQEFQHWDPDILCLQEVQEDHYWEQLEPSLRMMGFTCFYKRRTGCKTDGCAVCYKPTRFRLLCASPVEYFRPGLELLNRDNVGLVLLLQPLVPEGLGQVSVAPLCVANTHILYNPRRGDVKLAQMAILLAEVDKVARLSDGSHCPIILCGDLNSVPDSPLYNFIRDGELQYHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 9075 - protein, 262 aa, Homo sapiens
MFPHHSRSLGRDWTTPWENLQRCCWNRHISSCMRWPGHYSRAPYPYFSSRHFSLNWRPPCLFESRTQFQYCNWRPDNLSQTSLIHLSSYVMNAEGDEPSSKRRKHQGVIKRNWEYICSHDKEKTKILGDKNVDPKCEDSENKFDFSVMSYNILSQDLLEDNSHLYRHCRRPVLHWSFRFPNILKEIKHFDADVLCLQEVQEDHYGAEIRPSLESLGTMQLFFFFFFFETGSHSVAQLECSGTIMAHYSLNLLGSSNPLISAS

SEQ ID NO: 9076 - protein, 375 aa, Homo sapiens
MSYNILSQDLLEDNSHLYRHCRRPVLHWSFRFPNILKEIKHFDADVLCLQEVQEDHYGAEIRPSLESLGYHCEYKMRTGRKPDGCAICFKHSKFSLLSVNPVEFFRPDISLLDRDNVGLVLLLQPKIPYAACPAICVANTHLLYNPRRGDIKLTQLAMLLAEISSVAHQKDGSFCPIVMCGDFNSVPGSPLYSFIKEGKLNYEGLPIGKVSGQEQSSRGQRILSIPIWPPNLGISQNCVYEVQQVPKVEKTDSDLTQTQLKQTEVLVTAEKLSSNLQHHFSLSSVYSHYFPDTGIPEVTTCHSRSAITVDYIFYSAEKEDVAGHPGAEVALVGGLKLLARLSLLTEQDLWTVNGLPNENNSSDHLPLLAKFRLEL

SEQ ID NO: 9077 - protein, 544 aa, Homo sapiens
MEAWRCVRKGYGHCVVGRGRYPMFPHHSRSLGRDWTTPWENLQRCCWNRHISSCMRWPGHYSRAPYPYFSSRHFSLNWRPPCLFESRTQFQYCNWRPDNLSQTSLIHLSSYVMNAEGDEPSSKRRKHQGVIKRNWEYICSHDKEKTKILGDKNVDPKCEDSENKFDFSVMSYNILSQDLLEDNSHLYRHCRRPVLHWSFRFPNILKEIKHFDADVLCLQEVQEDHYGAEIRPSLESLGYHCEYKMRTGRKPDGCAICFKHSKFSLLSVNPVEFFRPDISLLDRDNVGLVLLLQPKIPYAACPAICVANTHLLYNPRRGDIKLTQLAMLLAEISSVAHQKDGSFCPIVMCGDFNSVPGSPLYSFIKEGKLNYEGLPIGKVSGQEQSSRGQRILSIPIWPPNLGISQNCVYEVQQVPKVEKTDSDLTQTQLKQTEVLVTAEKLSSNLQHHFSLSSVYSHYFPDTGIPEVTTCHSRSAITVDYIFYSAEKEDVAGHPGAEVALVGGLKLLARLSLLTEQDLWTVNGLPNENNSSDHLPLLAKFRLEL

SEQ ID NO: 9078 - protein, 212 aa, Homo sapiens
MSYNILSQDLLEDNSHLYRHCRRPVLHWSFRFPNILKEIKHFDADVLCLQEVQEDHYGAEIRPSLESLGYHCEYKMRTGRKPDGCAICFKHSKFSLLSVNPVEFFRPDISLLDRDNVGLVLLLQPKIPYAACPAICVANTHLLYNPRRGDIKLTQLAMLLAEISSVAHQKDGSFCPIVMCGDFNSVPGSPLYSFIKEGKLNYEGLPIGKTVI

SEQ ID NO: 9079 - protein, 418 aa, Homo sapiens
MEGVIKRNWEYICSHDKEKTKILGDKNVDPKCEDSENKFDFSVMSYNILSQDLLEDNSHLYRHCRRPVLHWSFRFPNILKEIKHFDADVLCLQEVQEDHYGAEIRPSLESLGYHCEYKMRTGRKPDGCAICFKHSKFSLLSVNPVEFFRPDISLLDRDNVGLVLLLQPKIPYAACPAICVANTHLLYNPRRGDIKLTQLAMLLAEISSVAHQKDGSFCPIVMCGDFNSVPGSPLYSFIKEGKLNYEGLPIGKVSGQEQSSRGQRILSIPIWPPNLGISQNCVYEVQQVPKVEKTDSDLTQTQLKQTEVLVTAEKLSSNLQHHFSLSSVYSHYFPDTGIPEVTTCHSRSAITVDYIFYSAEKEDVAGHPGAEVALVGGLKLLARLSLLTEQDLWTVNGLPNENNSSDHLPLLAKFRLEL

SEQ ID NO: 9080 - protein, 375 aa, Homo sapiens; identical to SEQ ID NO: 9076

SEQ ID NO: 9081 - protein, 839 aa, Homo sapiens
MSAGDGLRRGKSARCGLTFSVGRFFRWMVDTRISVRIHEYAAISLTACMENLVEEIRARVMASHSPDGGGAGGGEVSAEALEMVINNDAELWGVLQPYEHLICGKNANGVLSLPAYFSPYNGGSLGHDERADAYAQLELRTLEQSLLATCVGSISELSDLVSRAMHHMQGRHPLCPGASPARQARQPPQPITWSPDALHTLYYFLRCPQMESMENPNLDPPRMTLNNERPFMLLPPLMEWMRVAITYAEHRRSLTVDSGDIRQAARLLLPGLDCEPRQLKPEHCFSSFRRLDARAATEKFNQDLGFRMLNCGRTDLINQAIEALGPDGVNTMDDQGMTPLMYACAAGDEAMVQMLIDAGANLDIQVPSNSPRHPSIHPDSRHWTSLTFAVLHGHISVVQLLLDAGAHVEGSAVNGGEDSYAETPLQLASAAGNYELVSLLLSRGADPLLSMLEAHGMGSSLHEDMNCFSHSAAHGHRNVLRKLLTQPQQAKADVLSLEEILAEGVEESDASSQGSGSEGPVRLSRTRTKALQEAMYYSAEHGYVDITMELRALGVPWKLHIWIESLRTSFSQSRYSVVQSLLRDFSSIREEEYNEELVTEGLQLMFDILKTSKNDSVIQQLATIFTHCYGSSPIPSIPEIRKTLPARLDPHFLNNKEMSDVTFLVEGKLFYAHKVLLVTASNRFKTLMTNKSEQDGDSSKTIEISDMKYHIFQMMMQYLYYGGTESMEIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 9082 - protein, 1025 aa, Homo sapiens
MAGTYSSTLKTLEDLTLDSGYGAGDSCRSLSLSSSKSNSQALNSSAQQHRGAAWWCYSGSMNSRHNSWDTVNTVLPEDPEVADLFSRCPRLPELEEFPWTEGDVARVLRKGAGGRRLPQFSAEAVRRLAGLLRRALIRVAREAQRLSVLHAKCTRFEVQSAVRLVHSWALAESCALAAVKALSLYSMSAGDGLRRGKSARCGLTFSVGRFFRWMVDTRISVRIHEYAAISLTACMENLVEEIRARVMASHSPDGGGAGGGEVSAEALEMVINNDAELWGVLQPYEHLICGKNANGVLSLPAYFSPYNGGSLGHDERADAYAQLELRTLEQSLLATCVGSISELSDLVSRAMHHMQGRHPLCPGASPARQARQPPQPITWSPDALHTLYYFLRCPQMESMENPNLDPPRMTLNNERPFMLLPPLMEWMRVAITYAEHRRSLTVDSGDIRQAARLLLPGLDCEPRQLKPEHCFSSFRRLDARAATEKFNQDLGFRMLNCGRTDLINQAIEALGPDGVNTMDDQGMTPLMYACAAGDEAMVQMLIDAGANLDIQVPSNSPRHPSIHPDSRHWTSLTFAVLHGHISVVQLLLDAGAHVEGSAVNGGEDSYAETPLQLASAAGNYELVSLLLSRGADPLLSMLEAHGMGSSLHEDMNCFSHSAAHGHRNVLRKLLTQPQQAKADVLSLEEILAEGVEESDASSQGSGSEGPVRLSRTRTKALQEAMYYSAEHGYVDITMELRALGVPWKLHIWIESLRTSFSQSRYSVVQSLLRDFSSIREEEYNEELVTEGLQLMFDILKTSKNDSVIQQLATIFTHCYGSSPIPSIPEIRKTLPARLDPHFLNNKEMSDVTFLVEGKLFYAHKVLLVTASNRFKTLMTNKSEQDGDSSKTIEISDMKYHIFQMMMQYLYYGGTESMEIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 9083 - protein, 41 aa, Homo sapiens
MQEELAWETDGLWDECASPVCLVRPLTNPPDLGKLRGQDPL

SEQ ID NO: 9084 - protein, 137 aa, Homo sapiens
MQELIGRRVNTRARNHVGRVALHWAAGAGHEQAVRLLLEHEAAVDEEDAVGALTEEGNTALHLAAGRGHMAVLQRLVDIGLDLEEQNAEGLTALHSAAGGSHPDCVQLLLRAGSTVNALTQVARPSQDCGRLLAAEP

SEQ ID NO: 9085 - protein, 490 aa, Homo sapiens
MQEELAWETDGLLPLERQLHEAARQNNVGRMQELIGRRVNTRARNHVGRVALHWAAGAGHEQAVRLLLEHEAAVDEEDAVGALTEARLCFGMNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAGWSTMARSQLTATSASRVQMILVPQPPE

SEQ ID NO: 9086 - protein, 522 aa, Homo sapiens
MQEELAWETDGLLPLERQLHEAARQNNVGRMQELIGRRVNTRARNHVGRVALHWAAGAGHEQAVRLLLEHEAAVDEEDAVGALTEARLCFGMNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKQGKTALAVAVRSNHVSLVDMIIKADRFYRWEKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAGWSTMARSQLTATSASRVQMILVPQPPE

SEQ ID NO: 9087 - protein, 514 aa, Homo sapiens
MQEELAWETDGLLPLERQLHEAARQNNVGRMQELIGRRVNTRARNHVGRVALHWAAGAGHEQAVRLLLEHEAAVDEEDAVGALTEARLCFGMNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKQGKTALAVAVRSNHVSLVDMIIKADRFYRWEKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAENIRKKANAAPSAPRRCTAM

SEQ ID NO: 9088 - protein, 399 aa, Homo sapiens
MNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAGWSTMARSQLTATSASRVQMILVPQPPE

SEQ ID NO: 9089 - protein, 181 aa, Homo sapiens
MNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQVARPSQDCGRLLAAEP

SEQ ID NO: 9090 - protein, 89 aa, Homo sapiens
MLGGLGKLAAEGLAHRTEKATEGAIHAVEEVVKEVVGHAKETGEKAIAEAIKKAQESGDKKMKEITETVTNTVTNAITHAAESLDKLGQ

SEQ ID NO: 9091 - protein, 1089 aa, Homo sapiens
MGNTTTKFRKALINGDENLACQIYENNPQLKESLDPNTSYGEPYQHNTPLHYAARHGMNKILGTFLGRDGNPNKRNVHNETSMHLLCMGPQIMISEGALHPRLARPTEDDFRRADCLQMILKWKGAKLDQGEYERAAIDAVDNKKNTPLHYAAASGMKACVELLVKHGGDLFAENENKDTPCDCAEKQHHKDLALNLESQMVFSRDPEAEEIEAEYAALDKREPYEGLRPQDLRRLKDMLIVETADMLQAPLFTAEALLRAHDWDREKLLEAWMSNPENCCQRSGVQMPTPPPSGYNAWDTLPSPRTPRTTRSSVTSPDEISLSPGDLDTSLCDICMCSISVFEDPVDMPCGHDFCRGCWESFLNLKIQEGEAHNIFCPAYDCFQLVPVDIIESVVSKEMDKRYLQFDIKAFVENNPAIKWCPTPGCDRAVRLTKQGSNTSGSDTLSFPLLRAPAVDCGKGHLFCWECLGEAHEPCDCQTWKNWLQKITEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHKRFQELDRFMHYYTRFKNHEHSYQLEQRLLKTAKEKMEQLSRALKETEGGCPDTTFIEDAVHVLLKTRRILKCSYPYGFFLEPKSTKKEIFELMQTDLEMVTEDLAQKVNRPYLRTPRHKIIKAACLVQQKRQEFLASVARGVAPADSPEAPRRSFAGGTWDWEYLGFASPEEYAEFQYRRRHRQRRRGDVHSLLSNPPDPDEPSESTLDIPEGGSSSRRPGTSVVSSASMSVLHSSSLRDYTPASRSENQDSLQALSSLDEDDPNILLAIQLSLQESGLALDEETRDFLSNEASLGAIGTSLPSRLDSVPRNTDSPRAALSSSELLELGDSLMRLGAENDPFSTDTLSSHPLSEARSDFCPSSSDPDSAGQDPNINDNLLGNIMAWFHDMNPQSIALIPPATTEISADSQLPCIKDGSEGVKDVELVLPEDSMFEDASVSEGRGTQIEENPLEENILAGEAASQAGDSGNEAANRGDGSDVSSQTPQTSSDWLEQVHLV

SEQ ID NO: 9092 - protein, 134 aa, Homo sapiens
MGNTTTKFRKALINGDENLACQIYENNPQLKESLDPNTSYGEPYQHNTPLHYAARHGMNKILGTFLGRDGNPNKRNVHNETSMHLLCMGPQIMISEGALHPRLARPTEDDFRRADCLQMILKWKGAKLDQGEYE

SEQ ID NO: 9093 - protein, 648 aa, Homo sapiens
MLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSVEMRFHRIDQAGLELLTS

SEQ ID NO: 9094 - protein, 938 aa, Homo sapiens
MLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 9095 - protein, 876 aa, Homo sapiens
MTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 9096 - protein, 941 aa, Homo sapiens
MYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRNKPAHTSWNMGAILEGKRSGFAPCGPKEQLSMEMILKAEEGNHEWICRILKDNFASADVADAKGYTVLAAAATHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKLDLLPSSLKLSNEPGPPQAYYSTDTALPEEGGRTALHMACEREDDNKCARDIVRLLLSHGANPNLLWSGHSPLSLSIASGNELVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 9097 - protein, 717 aa, Homo sapiens
MEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 9098 - protein, 711 aa, Homo sapiens
MYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQLSTLTPLHIAAALPGEEGVQIVELLLHAITDVDAKASDEDDTYKPGKLDLLPSSLKLSNEPGPPQAYYSTDTALPEEGGRTALHMACEREDDNKCARDIVRLLLSHGANPNLLWSGHSPLSLSIASGNELVVKELLTQGADPNLPLTKGLGSALCVACDLTYEHQRNMDSKLALIDRLISHGADILKPVMLRQGEKEAVGTAVDYGYFRFFQDRRIARCPFHTLMPAERETFLARKRLLEYMGLQLRQAVFAKESQWDPTWLYLCKRAELIPSHRMKKKGPSLPRGLDVKEQGQIPFFKFCYQCGRSIGVRLLPCPRCYGILTCSKYCKTKAWTEFHKKDCGDLVAIVTQLEQVSRRREEFQ

SEQ ID NO: 9099 - protein, 941 aa, Homo sapiens; identical to SEQ ID NO: 9096

SEQ ID NO: 9100 - protein, 439 aa, Homo sapiens
MEGAHASLSLEDEVSGAGSRQRPLEGKGGETPAAEEPGSLKNYAVFATRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIERRKRWRTIKLLLRRGADPNLCCVPMQVLFLAVKAGDVDGVRLLLEHGARTDICFPPQC

SEQ ID NO: 9101 - protein, 74 aa, Homo sapiens
MEGAHASLSLEDEVSGAGSRQRPLEGKGGETPAAEEPGSLKNYAVFATRDVSAAPEKEEEEAEGPLRAQDLRES

SEQ ID NO: 9102 - protein, 227 aa, Homo sapiens
MYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYK

SEQ ID NO: 9103 - protein, 339 aa, Homo sapiens
MRDVSAAPEKEEEEAEGPLRAQDLRESYIQLVQGVQEWQDGCMYQGEFGLNMKLGYGKFSWPTGESYHGQFYRDHCHGLGTYMWPDGSSFTGTFYLSHREGYGTMYMKTRLFQTHCHNDIVNLLLDCGADVNKCSDEGLTALSMCFLLHYPAQSFKPNVAERTIPEPQEPPKFPVVPILSSSFMDTNLESLYYEVNVPSQGSYELRPPPAPLLLPRVSGSHEGGHFQDTGQCGGSIDHRSSSLKGDSPLVKGSLGHVESGLEDVLGNTDRGSLCSAETKFESNVCVCDFSIELSQAMLERSAQSHSLLKMASPSPCTSSFDKGTMRRMALSMIESCSLL

SEQ ID NO: 9104 - protein, 246 aa, Homo sapiens
MYQGEFGLNMKLGYGKFSWPTGESYHGQFYRDHCHGLGTYMWPDGSSFTGTFYLSHREGYGTMYMKTRLFQGLYKADQRFGPGVETYPDGSQDVGLWFREQLIKLCTQIPSGFSLLRYPEFSSFITHSPARISLSEEEKTEWGLQEGQDPFFYDYKRFLLNDNLTLPPEMYVYSTNSDHLPMTSSFRKELDARIFLNEIPPFVEDGEPWFIINETPLLVKIQKQTYKFRLTATTTLSTFSWTVGPT

SEQ ID NO: 9105 - protein, 441 aa, Homo sapiens
MVHIKKGELTQEEKELLEVIGKGTVQEAGTLLSSKNVRVNCLDENGMTPLMHAAYKGKLDMCKLLLRHGADVNCHQHEHGYTALMFAALSGNKDITWVMLEAGAETDVVNSVGRTAAQMAAFVGQHDCVTIINNFFPRERLDYYTKPQGLDKEPKLPPKLAGPLHKIITTTNLHPVKIVMLVNENPLLTEEAALNKCYRVMDLICEKCMKQRDMNEVLAMKMHYISCIFQKCINFLKDGENKLDTLIKSLLKGRASDGFPVYQEKIIRESIRKFPYCEATLLQQLVRSIAPVEIGSDPTAFSVLTQAITGQVGFVDVEFCTTCGEKGASKRCSVCKMVIYCDQTCQKTHWFTHKKICKNLKDIYEKQQLEAAKEKRQEENHGKLDVNSNCVNEEQPEAEVGISQKDSNPEDSGEGKKESLESEAELEGLQDAPAGPQVSEE

SEQ ID NO: 9106 - protein, 429 aa, Homo sapiens
MLMSWSPEECKGQGEPLDDRHPLCARLVEKPSRGSEEHLKSGPGPIVTRTASGPALAFWQAVLAGDVGCVSRILADSSTGLAPDSVFDTSDPERWRDFRFNIRALRLWSLTYEEELTTPLHVAASRGHTEVLRLLLRRRARPDSAPGGRTALHEACAAGHTACVHVLLVAGADPNIADQDGKRPLHLCRGPGTLECAELLLRFGARVDGRSEEEEETPLHVAARLGHVELADLLLRRGACPDARNAEGWTPLLAACDVRCQSITDAEATTARCLQLCSLLLSAGADADAADQDKQRPLHLACRRGHAAVVELLLSCGVSANTMDYGGHTPLHCALQGPAAALAQSPEHVVRALLNHGAVRVWPGALPKKHQRFYSSLFALVRQPRSLQHLSRCALRSHLEGSLPQALPRLPLPPRLLRYLQLDFEGVLY

SEQ ID NO: 9107 - protein, 452 aa, Homo sapiens
MPWGKNSSPHWGHHLGCLPSAPACRIWRPHSRPAWEPPRPSPLLCQDMALQNALYTGDLARLQELFPPHSTADLLLESRAAEPRWSSHQRGLWSLTYEEELTTPLHVAASRGHTEVLRLLLRRRARPDSAPGGRTALHEACAAGHTACVHVLLVAGADPNIADQDGKRPLHLCRGPGTLECAELLLRFGARVDGRSEEEEETPLHVAARLGHVELADLLLRRGACPDARNAEGWTPLLAACDVRCQSITDAEATTARCLQLCSLLLSAGADADAADQDKQRPLHLACRRGHAAVVELLLSCGVSANTMDYGGHTPLHCALQGPAAALAQSPEHVVRALLNHGAVRVWPGALPKVLERWSTCPRTIEVLMNTYSVVQLPEEAVGLVTPETLQKHQRFYSSLFALVRQPRSLQHLSRCALRSHLEGSLPQALPRLPLPPRLLRYLQLDFEGVLY

SEQ ID NO: 9108 - protein, 467 aa, Homo sapiens
MLMSWSPEECKGQGEPLDDRHPLCARLVEKPSRGSEEHLKSGPGPIVTRTASGPALAFWQAVLAGDVGCVSRILADSSTGLAPDSVFDTSDPERWRDFRFNIRALRLWSLTYEEELTTPLHVAASRGHTEVLRLLLRRRARPDSAPGGRTALHEACAAGHTACVHVLLVAGADPNIADQDGKRPLHLCRGPGTLECAELLLRFGARVDGRSEEEEETPLHVAARLGHVELADLLLRRGACPDARNAEGWTPLLAACDVRCQSITDAEATTARCLQLCSLLLSAGADADAADQDKQRPLHLACRRGHAAVVELLLSCGVSANTMDYGGHTPLHCALQGPAAALAQSPEHVVRALLNHGAVRVWPGALPKVLERWSTCPRTIEVLMNTYSVVQLPEEAVGLVTPETLQKHQRFYSSLFALVRQPRSLQHLSRCALRSHLEGSLPQALPRLPLPPRLLRYLQLDFEGVLY

SEQ ID NO: 9109 - protein, 512 aa, Homo sapiens
MRGQVSLGAWDTGAFCLSVFPSCSLSLSLPLAYTSPPPHSPFPAHMLMSWSPEECKGQGEPLDDRHPLCARLVEKPSRGSEEHLKSGPGPIVTRTASGPALAFWQAVLAGDVGCVSRILADSSTGLAPDSVFDTSDPERWRDFRFNIRALRLWSLTYEEELTTPLHVAASRGHTEVLRLLLRRRARPDSAPGGRTALHEACAAGHTACVHVLLVAGADPNIADQDGKRPLHLCRGPGTLECAELLLRFGARVDGRSEEEEETPLHVAARLGHVELADLLLRRGACPDARNAEGWTPLLAACDVRCQSITDAEATTARCLQLCSLLLSAGADADAADQDKQRPLHLACRRGHAAVVELLLSCGVSANTMDYGGHTPLHCALQGPAAALAQSPEHVVRALLNHGAVRVWPGALPKVLERWSTCPRTIEVLMNTYSVVQLPEEAVGLVTPETLQKHQRFYSSLFALVRQPRSLQHLSRCALRSHLEGSLPQALPRLPLPPRLLRYLQLDFEGVLY

SEQ ID NO: 9110 - protein, 474 aa, Homo sapiens
MRGQVSLGAWDTGAFCLSVFPSCSLSLSLPLAYTSPPPHSPFPAHMLMSWSPEECKGQGEPLDDRHPLCARLVEKPSRGSEEHLKSGPGPIVTRTASGPALAFWQAVLAGDVGCVSRILADSSTGLAPDSVFDTSDPERWRDFRFNIRALRLWSLTYEEELTTPLHVAASRGHTEVLRLLLRRRARPDSAPGGRTALHEACAAGHTACVHVLLVAGADPNIADQDGKRPLHLCRGPGTLECAELLLRFGARVDGRSEEEEETPLHVAARLGHVELADLLLRRGACPDARNAEGWTPLLAACDVRCQSITDAEATTARCLQLCSLLLSAGADADAADQDKQRPLHLACRRGHAAVVELLLSCGVSANTMDYGGHTPLHCALQGPAAALAQSPEHVVRALLNHGAVRVWPGALPKKHQRFYSSLFALVRQPRSLQHLSRCALRSHLEGSLPQALPRLPLPPRLLRYLQLDFEGVLY

SEQ ID NO: 9111 - protein, 286 aa, Homo sapiens
MRIVLQLAKMNLMDITKIFSLLQPDKEEEDTDTEEKQALNQAVYDNDSYTLDQLLRQERYKRFINSRSGWGVPGTPLRLAASYGHLSCLQVLLAHGADVDSLDVKAQTPLFTAVSHGHLDCVRVLLEAGASPGGSIYNNCSPVLTAARDGAVAILQELLDHGAEANVKAKLPVWASNIASCSGPLYLAAVYGHLDCFRLHHNCEPEYIQLLIDFGANIYLPSLSLDLTSQDDKGIALLLQARATPRSLLSQVRLVVRRALCQAGQPQAINQLDIPPMLISYLKHQL

SEQ ID NO: 9112 - protein, 318 aa, Homo sapiens
MRIVLQLAKMNLMDITKIFSLLQPDKEEEDTDTEEKQALNQAVYDNDSYTLDQLLRQERYKRFINSRSGWGVPGTPLRLAASYGHLSCLQVLLAHGADVDSLDVKAQTPLFTAVSHGHLDCVRVLLEAGASPGGSIYNNCSPVLTAARDGAVAILQELLDHGAEANVKAKLPVWASNIASCSGPLYLAAVYGHLDCFRLLLLHGADPDYNCTDQGLLARVPRPRTLLEICLHHNCEPEYIQLLIDFGANIYLPSLSLDLTSQDDKGIALLLQARATPRSLLSQVRLVVRRALCQAGQPQAINQLDIPPMLISYLKHQL

SEQ ID NO: 9113 - protein, 309 aa, Homo sapiens
MNLMDITKIFSLLQPDKEEEDTDTEEKQALNQAVYDNDSYTLDQLLRQERYKRFINSRSGWGVPGTPLRLAASYGHLSCLQVLLAHGADVDSLDVKAQTPLFTAVSHGHLDCVRVLLEAGASPGGSIYNNCSPVLTAARDGAVAILQELLDHGAEANVKAKLPVWASNIASCSGPLYLAAVYGHLDCFRLLLLHGADPDYNCTDQGLLARVPRPRTLLEICLHHNCEPEYIQLLIDFGANIYLPSLSLDLTSQDDKGIALLLQARATPRSLLSQVRLVVRRALCQAGQPQAINQLDIPPMLISYLKHQL

SEQ ID NO: 9114 - protein, 587 aa, Homo sapiens
MDNYTSDEDIDEDFDTQLIIQQSLQDIYKPGTAQHAPKDESLHSFLSADYKKIVETIEKVGKEDALSHLTKYHSAFGEADEIGWIPLHKAAVQLNRKILEITLSASDPSLWEQTTHNGETPLFLAVSSCLLENATFLLLNGCNPNAKNFEGNSPLLAAVLRDCYDMAALLINYGADVNLRCANERTALHEAAKLGREDMVKLMLVSGAHPDPQSTYGFTPLALAAQSGHTEIMEMLLRKGKIFCLASDSSSILLEAASGGNPDAVALLLEYGADANIPKNSGHLPIHVAADRGHLLALKILIPVTDLAAIKQSGISPVHCAAAGAHPQCLELLIQAGFDVNFMLDQRINKHYDDHRKSALYFAVSNSDLSSVKLLLSAGALPNQDPVNCLQIALRMGNYELISLLLRHGANVNYFCRVNPLHFPSALQYTLKDEVMLRMLLNYGYDTERCFDCPHGDKVHPSYTVEGWTSTVIKDTKFCEVITLSWLQHLSGKVVRVMLDYVDQVRICSKLKAVLQKQGIWSEIHFILTNPRSLKHLCRLKIRKCMGRLHLRCPVFMSFLPLPNRLKAYVLYKEYDLYGQGIFTGTW

SEQ ID NO: 9115 - protein, 423 aa, Homo sapiens
MAALLINYGADVNLRCANERTALHEAAKLGREDMVKLMLVSGAHPDPQSTYGFTPLALAAQSGHTEIMEMLLRKGANAHGQASDSSSILLEAASGGNPDAVALLLEYGADANIPKNSGHLPIHVAADRGHLLALKILIPVTDLAAIKQSGISPVHCAAAGAHPQCLELLIQAGFDVNFMLDQRINKHYDDHRKSALYFAVSNSDLSSVKLLLSAGALPNQDPVNCLQIALRMGNYELISLLLRHGANVNYFCRVNPLHFPSALQYTLKDEVMLRMLLNYGYDTERCFDCPHGDKVHPSYTVEGWTSTVIKDTKFCEVITLSWLQHLSGKVVRVMLDYVDQVRICSKLKAVLQKQGIWSEIHFILTNPRSLKHLCRLKIRKCMGRLHLRCPVFMSFLPLPNRLKAYVLYKEYDLYGQGIFTGTW

SEQ ID NO: 9116 - protein, 587 aa, Homo sapiens
MDNYTSDEDIDEDFDTQLIIQQSLQDIYKPGTAQHAPKDESLHSFLSADYKKIVETIEKGKEDALSHLTKYHSAFGEADEIGWIPLHKAAVQLNRKILEITLSASDPSLWEQTTHNGETPLFLAVSSCLLENATFLLLNGCNPNAKNFEGNSPLLAAVLRDCYDMAALLINYGADVNLRCANERTALHEAAKLGREDMVKLMLVSGAHPDPQSTYGFTPLALAAQSGHTEIMEMLLRKGANAHGQASDSSSILLEAASGGNPDAVALLLEYGADANIPKNSGHLPIHVAADRGHLLALKILIPVTDLAAIKQSGISPVHCAAAGAHPQCLELLIQAGFDVNFMLDQRINKHYDDHRKSALYFAVSNSDLSSVKLLLSAGALPNQDPVNCLQIALRMGNYELISLLLRHGANVNYFCRVNPLHFPSALQYTLKDEVMLRMLLNYGYDTERCFDCPHGDKVHPSYTVEGWTSTVIKDTKFCEVITLSWLQHLSGKVVRVMLDYVDQVRICSKLKAVLQKQGIWSEIHFILTNPRSLKHLCRLKIRKCMGRLHLRCPVFMSFLPLPNRLKAYVLYKEYDLYGQGIFTGTW

SEQ ID NO: 9117 - protein, 588 aa, Homo sapiens
MDTNDDPDEDHLTSYDIQLSIQESIEASKTALCPERFVPLSAQNRKLVEAIKQGHIPELQEYVKYKYAMDEADEKGWFPLHEAVVQPIQQILEIVLDASYKTLWEFKTCDGETPLTLAVKAGLVENVRTLLEKGVWPNTKNDKGETPLLIAVKKGSYDMVSTLIKHNTSLDQPCVKRWSAMHEAAKQGRKDIVALLLKHGGNVHLRDGFGVTPLGVAAEYGHCDVLEHLIHKGGDVLALADDGASVLFEAAGGGNPDCISLLLEYGGSGNVPNRAGHLPIHRAAYEGHYLALKYLIPVTSKNAIRKSGLTPIHSAADGQNAQCLELLIENGFDVNTLLADHISQSYDDERKTALYFGVSNNDVHCTEVLLAAGADPNLDPLNCLLVAVRANNYEIVRLLLSHGANVNCYFMHVNDTRFPSVIQYALNDEVMLRLLLNNGYQVEMCFDCMHGDIFGNSFVWSEIQEEVLPGWTSCVIKDNPFCEFITVPWMKHLVGRVTRVLIDYMDYVPLCAKLKSALEVQREWPEIRQILENPCSLKHLCRLKIRRLMGLQKLCQPASVEKLPLPPAIQRYILFKEYDLYGQELKLT

SEQ ID NO: 9118 - protein, 588 aa, Homo sapiens; identical to SEQ ID NO: 9117

SEQ ID NO: 9119 - protein, 97 aa, Homo sapiens
MDTNDDPDEDHLTSYDIQLSIQESIEASKTALCPERFVPLSAQNRKLVEAIKQGHIPELQEYVKYKYAMDEADEKGWFPLHEAVVQPIQQILEIVLD

SEQ ID NO: 9120 - protein, 241 aa, Homo sapiens
MDTNDDPDEDHLTSYDIQLSIQESIEASKTALCPERFVPLSAQNRKLVEAIKQGHIPELQEYVKYKYAMDEADEKGWFPLHEAVVQPIQQILEIVLDASYKTLWEFKTCDGETPLTLAVKAGLVENVRTLLEKGVWPNTKNDKGETPLLIAVKKGSYDMVSTLIKHNTSLDQPCVKRWSAMHEAAKQGRKDIVALLLKHGGNVHLRDGFGVTPLGVAAEYGHCDVLEHLIHKGGDVLALAD

SEQ ID NO: 9121 - protein, 588 aa, Homo sapiens; identical to SEQ ID NO: 9117

SEQ ID NO: 9122 - protein, 588 aa, Homo sapiens; identical to SEQ ID NO: 9117

SEQ ID NO: 9123 - protein, 588 aa, Homo sapiens; identical to SEQ ID NO: 9117

SEQ ID NO: 9124 - protein, 249 aa, Homo sapiens
MKQPSKAEYGHCDVLEHLIHKGGDVLALADDGASVLFEAAGGGNPDCISLLLEYGGSGNVPNRAGHLPIHRAAYEGHYLALKYLIPVTSKNAIRKSGLTPIHSAADGQNAQCLELLIENGFDVNTLLADHISQSYDDERKTALYFGVSNNDVHCTEVLLAAGADPNLDPLNCLLVAVRANNYEIVRLLLSHGANVNCYFMHVNDTRFPSVIQYALNDEVMLRLLLNNGYQVEMCFDCMHGDIFGNSFVC

SEQ ID NO: 9125 - protein, 453 aa, Homo sapiens
MARETFPFTSSMLRSLRLQQEWLEWEDRRRAAAQQCRSRRCPSSPRARLTRPHRSCRDPAVHQALFSGNLQQVQALFQDEEAANMIVETVSNQLAWSAEQGFWVLTPKTKQTAPLAIATARGYTDCARHLIRQGAELDARVGGRAALHEACARAQFDCVRLLLTFGAKANVLTEEGTTPLHLCTIPESLQCAKLLLEAGATVNLAAGESQETPLHVAAARGLEQHVALYLEHGADVGLRTSQGETALNTACAGAEGPGSCRRHQAAARRLLEAGADARAAGRKRHTPLHNACANGCGGLAELLLRYGARAEVPNGAGHTPMDCALQAVQDSPNWEPEVLFAALLDYGAQPVRPEMLKHCANFPRALEVLLNAYPCVPSCETWVEAVLPELWKEHEAFYSSALCMVNQPRQLQHLARLAVRARLGSRCRQGATRLPLPPLLRDYLLLRVEGCIQ

SEQ ID NO: 9126 - protein, 295 aa, Homo sapiens
MSKSTKLCGKTSCPRSNIFCNLLDKIVKRPSLQFLGQWGYHCYEPRIYRSLAKILRYVDLDGFDALLTDYIAFVEKSGYRFEVSFNLDFTEICVNTILYWVFARKGNPDFVELLLKKTKDYVQDRSCNLALIWRTFTPVYCPSPLSGITPLFYVAQTRQSNIFKILLQYGILEREKNPINIVLTIVLYPSRVRVMVDRELADIHEDAKTCLVLCSRVLSVISVKEIKTQLSLGRHPIISNWFDYIPSTRYKDPCELLHLCRLTIRNQLLTNNMLPDGIFSLLIPARLQNYLNLEI

SEQ ID NO: 9127 - protein, 437 aa, Homo sapiens
MERQPGPVRGKLQIFQKTEKDPQARAGSPVQEYHTALVAGDLDHLKPLMDQFFQDANVVFEINKDEMEWQVKSPATFGLSGLWTLEYKRELTTPLCIAAAHGHTACVRHLLGRGADPDASPGGRGALHEACLGGHTACVRLLLQHRADPDLLSAEGLAPLHLCRTAASLGCAQALLEHGASVQRVGGTGRDTPLHVAAQRGLDEHARLYLGRGAHVDARNGRGETALSAACGAARRPDEHGRCLRLCALLLRRGAEADARDEDERSPLHKACGHASHSLARLLLRHGADAGALDYGGASPLGRVLQTASCALQASPQRTVQALLNHGSPTVWPDAFPKVLKTCASVPAVIEVLFNSYPQLCLSESWKEVIPEEVFQMHKPFYQSLFALALTPRCLQHLCRCALRRLFGKRCFDLIPLLPLPKPLQNYLLLEPQGVLH

SEQ ID NO: 9128 - protein, 466 aa, Homo sapiens
MSNSDYLPDYPLNSDLVKRLKSALDAKDEERVRDLICTEITPVDAVIELANDDWMKDPSAQLPTGMLLGDLDHLKPLMDQFFQDANVVFEINKDEMEWQVKSPATFGLSGLWTLEYKRELTTPLCIAAAHGHTACVRHLLGRGADPDASPGGRGALHEACLGGHTACVRLLLQHRADPDLLSAEGLAPLHLCRTAASLGCAQALLEHGASVQRVGGTGRDTPLHVAAQRGLDEHARLYLGRGAHVDARNGRGETALSAACGAARRPDEHGRCLRLCALLLRRGAEADARDEDERSPLHKACGHASHSLARLLLRHGADAGALDYGGASPLGRVLQTASCALQASPQRTVQALLNHGSPTVWPDAFPKVLKTCASVPAVIEVLFNSYPQLCLSESWKEVIPEEVFQMHKPFYQSLFALALTPRCLQHLCRCALRRLFGKRCFDLIPLLPLPKPLQNYLLLEPQGVLH

SEQ ID NO: 9129 - protein, 329 aa, Homo sapiens
MSVLEENRPFAQQLSNVYFTILSLFCFKLFVKISLAILSHFYIVKGNRKEAARIAAEFYGVTQGQGSWADRSPLHEAASQGRLLALRTLLSQGYNVNAVTLDHVTPLHEACLGDHVACARTLLEAGANVNAITIDGVTPLFNACSQGSPSCAELLLEYGAKAQLESCLPSPTHEAASKGHHECLDILISWGIDVDQEIPHLGTPLYVACMSQQFHCIWKLLYAGADVQKGKYWDTPLHAAAQQSSTEIVNLLLEFGADINAKNTELLRPIDVATSSSMVERILLQHEATPSSLYQLCRLCIRSYIGKPRLHLIPQLQLPTLLKNFLQYR

SEQ ID NO: 9130 - protein, 20 aa, Homo sapiens
MSVLEENRPFAQQLSNVYFT

SEQ ID NO: 9131 - protein, 318 aa, Homo sapiens
MLHHHCRRNPELQEELQIQAAVAAGDVHTVRKMLEQGYSPNGRDANGWTLLHFSAARGKERCVRVFLEHGADPTVKDLIGGFTALHYAAMHGRARIARLMLESEYRSDIINAKSNDGWTPLHVAAHYGRDSFVRLLLEFKAEVDPLSDKGTTPLQLAIIRERSSCVKILLDHNANIDIQNGFLLRYAVIKSNHSYCRMFLQRGADTNLGRLEDGQTPLHLSALRDDVLCARMLYNYGADTNTRNYEGQTPLAVSISISGSSRPCLDFLQEVTRQPRNLQDLCRIKIRQCIGLQNLKLLDELPIAKVMKDYLKHKFDDI

SEQ ID NO: 9132 - protein, 274 aa, Homo sapiens
MLHHHCRRNPELQEELQIQAAVAAGDVHTVRKMLEQGYSPNGRDANGWTLLHFSAARGKERCVRVFLEHGADPTVKDLIGGFTALHYAAMHGRARIARLMLESEYRSDIINAKSNDGWTPLHVAAHYGRDSFVRLLLEFKAEVDPLSDKGTTPLQLAIIRERSSCVKILLDHNANIDIQNGFLLRYAVIKSNHSYCRMFLQRGADTNLGRLEDGQTPLHLSALRDDVLCARMLYNYGADTNTRNYEGQTPLAVSISISGSSRPCLDFLQEVTSM

SEQ ID NO: 9133 - protein, 252 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRAYGGNIDHKISHLGTPLYLACENQQRACVKKLLESGADVNQGKGQDSPLHAVARTASEELACLLMDFGADTQAKNAEGKRPVELVPPESPLAQLFLEREGASLPKPKP

SEQ ID NO: 9134 - protein, 262 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREGASLPKPKP

SEQ ID NO: 9135 - protein, 294 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLSCVKILLKHGAQVNGVTADWHTPLFNACVSGSWDCVNLLLQHGASVQPESDLASPIHEAARRGHVECVNSLIAYGGNIDHKISHLGTPLYLACENQQRACVKKLLESGADVNQGKGQDSPLHAVARTASEELACLLMDFGADTQAKNAEGKRPVELVPPESPLAQLFLEREGPPSLMQLCRLRIRKCFGIQQHHKITKLVLPEDLKQFLLHL

SEQ ID NO: 9136 - protein, 262 aa, Homo sapiens; identical to SEQ ID NO: 9134

SEQ ID NO: 9137 - protein, 656 aa, Homo sapiens
MSELSDEASEPELLNRSLSMWHGLGTQVSGEELDVPLDLHTAASIGQYEVVKECVQRRELDLNKKNGGGWTPLMYASYIGHDTIVHLLLEAGVSVNVPTPEGQTPLMLASSCGNESIAYFLLQQGAELEMKDIQGWTALFHCTSAGHQHMVRFLLDSGANANVREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 9138 - protein, 527 aa, Homo sapiens
MKDIQGWTALFHCTSAGHQHMVRFLLDSGANANVREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 9139 - protein, 306 aa, Homo sapiens
MLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRAATDREGFLAESSPQTQRAPYSGPQVRPLVKLEVTLRDGTFCDLGGMCCVYDVPGAARRTEWRWHPHGLLGSTGSQPAPWLAAPLQRFYSVPLHGKDLSPCFPYWSWPP

SEQ ID NO: 9140 - protein, 424 aa, Homo sapiens
MRIFIAFEGSFEPFDVSADETVEVVKLMIKDYFHIPLSEDKQGRRYLELMYAGAALKDSWSLADVGISFCSTLKCFVKEEDKPTLYVFNAVTQDTMPVMESISLLDKTVSDLRTLVTLRCGLPVSVYCLRTPRGLEMYDCNTLKDYQTDIGTTLRLDVWDGWKEFLMGCLLGQKLKVQRYLSKEGPVLKYQKRVALYIAAFCGYIELTEWALKQGARPHEAVGVHPYRAWCHEALHADVSKCPIHAAAEAGQLLILKAFVNYSVLCLECKNAAGQTPLTIVFKHKHKDCVLYLLSKMWSTVSFPKISVPMRIYIKIKQWILRAQSHSLHKSQFCGARVFGAKVGDTVMVDGFTKPKMTSKSWHKAGNSDSQSIVLKLPSLSKQTASSKPVNPLAISQPDTRKQALKFHPLKGESPKADKSSGIM

SEQ ID NO: 9141 - protein, 544 aa, Homo sapiens
MRIFIAFEGSFEPFDVSADETVEVVKLMIKDYFHIPLSEDKQGRRYLELMYAGAALKDSWSLADVGISFCSTLKCFVKEEDKPTLYVFNAVTQDTMPVMESISLLDKTVSDLRTLVTLRCGLPVSVYCLRTPRGLEMYDCNTLKDYQTDIGTTLRLDVWDGWKEFLMGCLLGQKLKVQRYLSKEGPVLKYQKRVALYIAAFCGYIELTEWALKQGARPHEAVGVHPYRAWCHEALHADVSKCPIHAAAEAGQLLILKAFVNYSVLCLECKNAAGQTPLTIVFKHKHKDCVLYLLSKMWSTVSFPKISVPMRIYIKIKQWILRAQSHSLHKSQFCGARVFGAKVGDTVMVDGFTKPKMTSKSWHKAGNSDSQSIVLKLPSLSKQTASSKPVNPLAISQPDTRKQALKFHPLVNASSFSELQKHQQQNQKKITATARKKEKLIKNTYLPQVPLPPVSRVGYSHPSFFYATPSADFLLKSSFSSFLEHSGKTPWENAIYCLAVASAFKEKRWLQQLEIARVLAKKSISNLTTRGGLTACENSLETVL

SEQ ID NO: 9142 - protein, 726 aa, Homo sapiens
MSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGSGSEGEDGFQVELELVELTVGTLDLCESEVLPKRRRRKRNKKEKSRDQEAGAHRTLLQQTQEEEPSTQSSQAVAAPLGPLLDEAKAPGQPELWNALLAACRAGDVGVLKLQLAPSPADPRVLSLLSAPLGSGGFTLLHAAAAAGRGSVVRLLLEAGADPTVQDSRARPPYTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 9143 - protein, 726 aa, Homo sapiens; identical to SEQ ID NO: 9142

SEQ ID NO: 9144 - protein, 90 aa, Homo sapiens
MSPAPDAAPAPASISLFDLSADAPVFQGLSLVSHAPGEALARAPRTSCSGSGERESPERKLLQGPMDISEKLFCSTCDQTFQNHQEQREH

SEQ ID NO: 9145 - protein, 140 aa, Homo sapiens
MSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEED

SEQ ID NO: 9146 - protein, 420 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVDLRNASGLTAADIAQTQGFQECAQFLLNLQNCHLNHFYNNGILNGGHQNVFPNHISVGTNRKRCLEDSEDFGVKKARTEAQSLDSAVPLTNGDTEDDADKMHVDREFAVVTDMKNSSSVSNTLTNGCVINGHLDFPSTTPLSGMESRNGQCLTGTNGISSGLAPGQPFPSSQGSLCISGTEEPEKTLRANPELCGSLHLNGSPSSCIASRPSWVEDIGDNLYYGHYHGFGDTAESIPELNSVVEHSKSVKVQERYDSAVLGTMHLHHGS

SEQ ID NO: 9147 - protein, 220 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVEFISQSSVHSCLPGELQHGVTFDPSVLIQCLKPEKCQWPDSSRHCTNPGFPRVCPVSLEPPELSSEPFL

SEQ ID NO: 9148 - protein, 518 aa, Homo sapiens
MVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 9149 - protein, 518 aa, Homo sapiens; identical to SEQ ID NO: 9148

SEQ ID NO: 9150 - protein, 605 aa, Homo sapiens
MAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGALVMEVDHDRQVVHVETLGLTLQEPETLLAAMRPSEEHVASRLTSPIVSTHLDTRNVAFERNKCGIWGWRSEKMETVSGYEAKVYSATNVELVTRTRTEHLSDQDKSRSKAGKTPFQSFLGMAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 9151 - protein, 518 aa, Homo sapiens; identical to SEQ ID NO: 9148

SEQ ID NO: 9152 - protein, 255 aa, Homo sapiens
MSCGRLGRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 9153 - protein, 336 aa, Homo sapiens
MKPKSREVERRLTSPVINTSLDTKNIAFERTKSGFWGWRTDKAEVVNGYEAKVYTVNNVNVITKIRTEHLTEEEKKRYKDRNPLESLLGTVEHQFGAQGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 9154 - protein, 590 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKADRNPLESLLGTVEHQFGAQGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIEIPLFHVLNARITFGNVNGCSTAEESVSQNVEGTQADSASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 9155 - protein, 626 aa, Homo sapiens
MIPANASARKGPEGKYPLHYLVWHNRHRELEKEVRAGQVDIEQLDPRGRTPLHLATTLGHLECARVLLAHGADVGRENRSGWTVLQEAVSTRDLELVQLVLRYRDYQRVVKRLAGIPVLLEKLRKAQDFYVEMKWEFTSWVPLVSKICPSDTYKVWKSGQNLRVDTTLLGFDHMTWQRGNRSFVFRGQDTSAVVMEIDHDRRVVYTETLALAGQDRELLLAAAQPTEEQVLSRLTAPVVTTQLDTKNISFERNKTGILGWRSEKTEMVNGYEAKVYGASNVELITRTRTEHLSEQHKGKVKGCKTPLQSFLGIAEQHGGPQNGTLITQTLSQANPTAITAEEYFNPNFELGNRDMGRPMELTTKTQKFKAKLWLCEEHPLSLCEQVAPIIDLMAVSNALFAKLRDFITLRLPPGFPVKIEIPIFHILNARITFGNLNGCDEPVPSVRGSPSSETPSPGSDSSSVSSSSSTTSCRGCEISPALFEAPRGYSMMGGQREAATRDDDDDLLQFAIQQSLLEAGSEYDQVTIWEALTNSKPGTHPMSYEGRRQDRSAPPTPQRQPAPPASVPSPRPSSGPGSGGHVFRSYDEQLRLAMELSAQEQEERRRRARQEEEELERILRLSLTEQ

SEQ ID NO: 9156 - protein, 304 aa, Homo sapiens
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKPCIWPVQVSTWPVPSFSCSRD

SEQ ID NO: 9157 - protein, 361 aa, Homo sapiens
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKEGHTSTIQTLLSLGADINSKDEKNRSALHLACAGQHLACAKFLLQSGLKDSEDITGTLAQQLPRRADVLQGSGHSAMT

SEQ ID NO: 9158 - protein, 361 aa, Homo sapiens; identical to SEQ ID NO: 9157

SEQ ID NO: 9159 - protein, 205 aa, Homo sapiens
MKTAYEEVTTELEEFKEAFAGAVKANNSMSKKLMKSDKKIAVISTKLFTEKQRMKYFLSTLPTRPEPELPCVENLNSIELNRKYIPKTAIRIPTSNPQTSNNCKNFLTEMELDRVEQIITGTKKSFAMLSTCSRLLSFVESTAPRKHRRALPIMRSLVPNRRTTVASTESRTNRPGGVRSPGLQLEGTSTLQWEQGPIAHPRHRC

SEQ ID NO: 9160 - protein, 217 aa, Homo sapiens
MKTAYEEVTTELEEFKEAFAGAVKANNSMSKKLMKSDKKIAVISTKLFTEKQRMKYFLSTLPTRPEPELPCVENLNSIELNRKYIPKTAIRIPTSNPQTSNNCKNFLTEMELDRVEQIITGTKKSFAMLSTCSRLLSFVESTAPRKHRRALPIMRSLVPNRRTTVASTEMSQLLYKGVPFQSRTNRPGGVRSPGLQLEGTSTLQWEQGPIAHPRHRC

SEQ ID NO: 9161 - protein, 992 aa, Homo sapiens
MRKLFSFGRRLGQALLSSMDQEYAGPGYDIRDWELRKIHRAAIKGDAAEVERCLTRRFRDLDARDRKDRTVLHLACAHGRVQVVTLLLHRRCQIDICDRLNRTPLMKAVHSQEEACAIVLLECGANPNIEDIYGNTALHYAVYNKGTSLAERLLSHHANIEALNKEGNTPLLFAINSRRQHMVEFLLKNQANIHAVDNFKRTALILAVQHNLSSIVTLLLQQNIRISSQDMFGQTAEDYALCSDLRSIRQQILEHKNKMLKNHLRNDNQETAAMKPANLKKRKERAKAEHNLKVASEEKQERLQRSENKQPQDSQSYGKKKDAMYGNFMLKKDIAMLKEELYAIKNDSLRKEKKYIQEIKSITEINANFEKSVRLNEKMITKTVARYSQQLNDLKAENARLNSELEKEKHNKERLEAEVESLHSSLATAINEYNEIVERKDLELVLWRADDVSRHEKMGSNISQLTDKNELLTEQVHKARVKFNTLKGKLRETRDALREKTLALGSVQLDLRQAQHRIKEMKQMHPNGEAKESQSIGKQNSLEERIRQQELENLLLERQLEDARKEGDNKEIVINIHRDCLENGKEDLLEERNKELMKEYNYLKEKLLQCEKEKAEREVIVREFQEELVDHLKTFSISESPLEGTSHCHINLNETWTSKKKLFQVEIQPEEKHEEFRKLFELISLLNYTADQIRKKNRELEEEATGYKKCLEMTINMLNAFANEDFSCHGDLNTDQLKMDILFKKLKQKFNDLVAEKEAVSSECVNLAKDNEVLHQELLSMRNVQEKCEKLEKDKKMLEEEVLNLKTHMEKDMVELGKLQEYKSELDERAVQEIEKLEEIHLQKQAEYEKQLEQLNKDNTASLKKKELTLKDVECKFSKMKTAYEEVTTELEEFKEAFAGAVKANNSMSKKLMKSDKKIAVISTKLFTEKQRMKYFLSTLPTRPEPELPCVENLNSIELNRKYIPKTAIRIPTSNPQTSNNCKNFLTEVLLC

SEQ ID NO: 9162 - protein, 1011 aa, Homo sapiens
MRKLLSFGRRLGQALLSSMDQEYAGRGYHIRDWELRKIHRAAIKGDAAEVEHCLTRRFRDLDVRDRKDRTVLHLACAHGRVQVVTLLLDRKCQINICDRLNRTPLMKAVHCQEEACAIILLKRGANPNIKDIYGNTALHYAVYNEGTSLAERLLSHHANIEALNKEGNTPLLFAINSRRQHMVEFLLKNQANIHAVDNFKRTALILAVQHNLSSIVTLLLQQNIHISSQDMFGQTAEDYAFCCDLRSIQQQILEHKNKMLKNHLRNDNQETAAMKPENLKKRKKRKKLKKRKEGAKAEHNLKVASEEKQERLERSENKQPQDSQSYGKKKDEMFGNFMLKRDIAMLKEELYAIKNDSLRKEKKYIQEIKSITEINANFEKSVRLNEEMITKKVAQYSQQLNDLKAENARLNSKLEKEKHNKERLEAEVESLHSNLATAINEYNEILERKDLELVLWRADDVSRHETMGSNISQLTDKNELLTEQVHKARVKFNTLKGKLRETRDALREKTLALESVQLDLKQAQHRIKEMKQMHPNGEAKESQSIGKQNSSEERIRQRELENLLLERQLEDARKEGDNKEIVINIHRDCLENGKEDLLEERNKELMNEYNYLKEKLLQYEKEKAEREVIVREFQEELVDHLKKFSMSESPLEGTSHCHINLDETWTSKKKLFQVEIQPEEKHEEFRKVFELISLLNYTADQIRKKNRELEEEATGYKKCLEMTINMLNAFANEDFSCHGDLNTDQLKMDILFKKLKQKFDDLMAEKEAVSSKCVNLAKDNEVLHQELLSMGKVQEKCEKLEKDKKMLEEKVLNLKTHMEKDMVELGKVQEYKSELDERAMQAIEKLEEIHLQKQAEYEKQLEQLNKDNTASLKKKELTLKDVECKFSKMKTAYEDVTTELEEYKEAFAVALKANSSMSEKITKSDKKIAVISTKLFMEKERMEYFLSTLPMRPDPELPCVENLNSIELNRKYIPKMAIRIPTSNPQTSNNCKNSLTELLLRWALAPIYFLL

SEQ ID NO: 9163 - protein, 401 aa, Homo sapiens
EKEKAEREVIVREFQEELVDHLKKFSMSESPLEGTSHCHINLDETWTSKKKLFQVEIQPEEKHEEFRKVFELISLLNYTADQIRKKNRELEEEATGYKKCLEMTINMLNAFANEDFSCHGDLNTDQLKMDILFKKLKQKFDDLMAEKEAVSSKCVNLAKDNEVLHQELLSMGKVQEKCEKLEKDKKMLEEKVLNLKTHMEKDMVELGKVQEYKSELDERAMQAIEKLEEIHLQKQAEYEKQLEQLNKDNTASLKKKELTLKDVECKFSKMKTAYEDVTTELEEYKEAFAVALKANSSMSEKITKSDKKIAVISTKLFMEKERMEYFLSTLPMRPDPELPCVENLNSIELNRKYIPKMAIRIPTSNPQTSNNCKNSLTEMELDCAEQIITETKKSMLPKCIN

SEQ ID NO: 9164 - protein, 823 aa, Homo sapiens
MKLFGFGSRRGQTAQGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKRKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNRDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTRDVSVQVEMSSAISKVKDENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKKI

SEQ ID NO: 9165 - protein, 823 aa, Homo sapiens
MKLFGFGSRRGQTAQGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKRKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNRDFHNHEEMKGLMDENCILKADIAILRQEICTMKNDNLEKENKYLKDIKIVKETNAALEKYIKLNEEMITETAFRYQQELNYLKAENTRLNAELLKEKESKKRLEADIESYQSRLAAAISKHSESVKTERNLKLALERTRDVSVQVEMSSAISKVKDENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKTI

SEQ ID NO: 9166 - protein, 823 aa, Homo sapiens
MKLFGFGSRRGQTAQGSIDHVYTGSGYRIRDSELQKIHRAAVKGDAAEVERCLARRSGELDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKKKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQQRHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNWDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTQDVSVQVEMSSAISKVKDENEFLTEQLSETQIKFNALKDKFRKTRDSLRKKSLALETVQNNLSQTQQQTQEMKEMYQNAEAKVNNSTGKWNCVEERICHLQRENAWLVQQLDDVHQKEDHKEIVTNIQRGFIESGKKDFVLEEKSKKLMNECDHLKESLFQYEREKTEVVVSIKEDKYFQTSRKKI

SEQ ID NO: 9167 - protein, 191 aa, Homo sapiens
MGILYSEPICQAAYQNDFGQVWRWVKEDSSYANVQDGFNGDTPLICACRRGHVRIVSFLLRRNANVNLKNQKERTCLHYAVKKKFTFIDYLLIILLMPVLLIGYFLMVSKTKQNEALVRMLLDAGVEVNATDCYGCTALHYACEMKNQSLIPLLLEARADPTIKNKHGESSLDIARRLKFSQIELMLRKAL

SEQ ID NO: 9168 - protein, 1236 aa, Homo sapiens
MQPAACAGEGAGPPAPRPPHPPGDKVRRGRGGAPSLSPQPPAPYLGLPIPSRGGGGWRGGQGGGGGTREGGTGRAGGAGSSGSAQPRPPAAPRGPSRPSGRRLLLEPRAPPAPRAPDAMKQLCLCAAASFASQDWGKSDERLLQAVENNDAPRVAALIARKGLVPTKLDPEGKSAFHLAAMRGAASCLEVMIAHGSNVMSADGAGYNALHLAAKYGHPQCLKQLLQASCVVDVVDSSGWTALHHAAAGGCLSCSEVLCSFKAHLNPQDRSGATPLIIAAQMCHTDLCRLLLQQGAAANDQDLQGRTALMLACEGASPETVEVLLQGGAQPGITDALGQDAAHYGALAGDKLILHLLQEAAQRPSPPSALTEDDSGEASSQNSMSSHGKQGAPKKRKAPPPPASIPMPDDRDAYEEIVRLRQERGRLLQKIRGLEQHKERRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQRTAAAELGRARDAAEARVAELPAACEEARQGLAELREASEALRQSVVPASEHRRLQEEALELRGRAASLEQEVVATGKEAARLRAELERERVCSVALSEHERIVGTLQANVAQLEGQLEELGRRHEKTSAEVFQVQREALFMKSERHAAEAQLATAEQQLRGLRTEAERARQAQSRAQEALDKAKEKDKKITELSKEVFNLKEALKEQPAALATPEVEALRDQVKDLQQQLQEAARDHSSVVALYRSHLLYAIQGQMDEDVQRILSQILQMQRLQAQGR

SEQ ID NO: 9169 - protein, 1146 aa, Homo sapiens
MKTLRARFKKTELRLSPTDLGSCPPCGPCPIPKPAARGRRQSQDWGKSDERLLQAVENNDAPRVAALIARKGLVPTKLDPEGKSAFHLAAMRGAASCLEVMIAHGSNVMSADGAGYNALHLAAKYGHPQCLKQLLQASCVVDVVDSSGWTALHHAAAGGCLSCSEVLCSFKAHLNPQDRSGATPLIIAAQMCHTDLCRLLLQQGAAANDQDLQGRTALMLACEGASPETVEVLLQGGAQPGITDALGQDAAHYGALAGDKLILHLLQEAAQRPSPPSALTEDDSGEASSQNSMSSHGKQGAPKKRKAPPPPASIPMPDDRDAYEEIVRLRQERGRLLQKIRGLEQHKERRQQESPEASSLHILERQVQELQQLLVERQEEKESLGREVESLQSRLSLLENERENTSYDVTTLQDEEGELPDLPGAEVLLSRQLSPSAQEHLASLQEQVAVLTRQNQELMEKVQILENFEKDETQMEVEALAEVIPLALYDSLRAEFDQLRRQHAEALQALRQQETREVPREEGAACGESEVAGATATKNGPTHMELNGSVAPETKVNGAETIDEEAAGDETMEARTMEAEATGAEATGAEATGAKVTETKPTGAEVREMETTEEEANMETKPTGAQATDTETTGVEAMGVEATKTKAEEAEMQAYGVGAGQAEPPVTGTTNMEATGSRATGMESTGVSATGVENPGVEATVPGISAGPILHPGAAEASEKLQVELETRIRGLEEALRQREREAAAELEAALGKCEAAEAEAGRLRERVREAEGSGASGGGGGDTTQLRAALEQAREDLRDRDSRLRELEAASACLDEARASRLLAEEEARGLRAELAQREEARLEQSRELEVLREQLATARATGEQQRTAAAELGRARDAAEARVAELPAACEEARQGLAELREASEALRQSVVPASEHRRLQEEALELRGRAASLEQEVVATGKEAARLRAELERERVCSVALSEHERIVGTLQANVAQLEGQLEELGRRHEKTSAEVFQVQREALFMKSERHAAEAQLATAEQQLRGLRTEAERARQAQSRAQEALDKAKEKDKKITELSKEVFNLKEALKEQPAALATPEVEALRDQVKDLQQQLQEAARDHSSVVALYRSHLLYAIQGQMDEDVQRILSQILQMQRLQAQGR

SEQ ID NO: 9170 - protein, 1146 aa, Homo sapiens; identical to SEQ ID NO: 9169

SEQ ID NO: 9171 - protein, 268 aa, Homo sapiens
MEENSFQKETPLANAAFWAARRGNLALLKLLLNSGRVDVDCRDSHGTTLLMVAAYAGHIDCVRELVLQGADINLQRESGTTALFFAAQQGHNDVVRFLFGFGASTEFRTKDGGTALLAASQYGHMQVVETLLKHGANIHDQLYDGATALFLAAQGGYLDVIRLLLASGAKVNQPRQDGTAPLWIASQMGHSEVVRVMLLRGADRDAARNDGTTALLKAANKGYNDVIKELLKFSPTLGILKANELPAELTKNERILRLLRSKEGPRKS

SEQ ID NO: 9172 - protein, 301 aa, Homo sapiens
MCRMSFKKETPLANAAFWAARRGNLALLKLLLNSGRVDVDCRDSHGTTLLMVAAYAGHIDCVRELVLQGADINLQRESGTTALFFAAQQGHNDVVRFLFGFGASTEFRTKDGGTALLAASQYGHMQVVETLLKHGANIHDQLYDGATALFLAAQGGYLDVIRLLLASGAKVNQPRQDGTAPLWIASQMGHSEVVRVMLLRGADRDAARNDGTTALLKAANKGYNDVIKELLKFSPTLGILKNGTSALHAAVLSGNIKTVALLLEAGADPSLRNKANELPAELTKNERILRLLRSKEGPRKS

SEQ ID NO: 9173 - protein, 301 aa, Homo sapiens; identical to SEQ ID NO: 9172

SEQ ID NO: 9174 - protein, 812 aa, Homo sapiens
PCKTLLQNDVCLPKATHQKEFDTLSGKLEVYFCPIGMLTNTKTQKTPKPSVIPFQSKHDFLLESPDKDGLLKPTCGRKVSLPNKALELKDRETLKAESPDKDGLLKPTCVRKVSLPNKALELKDRETLKAAQMFPSESKQKDDEENSWDFESFLEALLQNDGCLPKATHQKEFDTLSGKLEESPDKDGLLKPTCGMKISLPNKALELKDRETFKAEDVSSVESTFSLFGKPTTENSQSTKVEEDFNLTTKEGATKTVTGQQERDIGIIERAPQDQTNKMPTSELGRKEDTKSTSDSEIISVSDTQNYECLPEATYQKEIKTTNGKIEESPEKPSHFEPATEMQNSVPNKGLEWKNKQTLRADSTTLSKILDALPSCERGRELKKDNCEQITAKMEQTKNKFCVLQKELSEAKEIKSQLENQKAKWEQELCSVRLTLNQEEEKRRNVDILKEKIRPEEQLRKKLEVKQQLEQTLRIQDIELKSVTSNLNQVSHTHESENDLFHENCMLKKEIAMLKLEVATLKHQHQVKENKYFEDIKILQEKNAELQMTLKLKQKTVTKRASQYREQLKVLTAENTMLTSKLKEKQDKEILETEIESHHPRLASALQDHDQSVTSRKNQELAFHSAGDAPLQGIMNVDVSNTIYNNEVLHQPLYEAQRKSKSPKINLNYAGDDLRENALVSEHAQRDRCETQCQMKKAEHMYQNEQDNVDKHTEQQESLEQKLFQLESKNRWLRQQLVYAHKKVNKSKVTINIQFPEMKMQRHLNEKNEEVFNYGNHLKERIDQYEKEKAEREVSIKKYKYFSNFLKESGLG

SEQ ID NO: 9175 - protein, 786 aa, Homo sapiens
NAWDLNSFLETLLQNDVCLPKATHQKEFDTLSGKLEESPDKDGLLKPTCGRKVSLPNKALELKDRETLKAESPDKDGLLKPTCVRKVSLPNKALELKDRETLKAAQMFPSESKQKDDEENSWDFESFLEALLQNDGCLPKATHQKEFDTLSGKLEESPDKDGLLKPTCGMKISLPNKALELKDRETFKAEDVSSVESTFSLFGKPTTENSQSTKVEEDFNLTTKEGATKTVTGQQERDIGIIERAPQDQTNKMPTSELGRKEDTKSTSDSEIISVSDTQNYECLPEATYQKEIKTTNGKIEESPEKPSHFEPATEMQNSVPNKGLEWKNKQTLRADSTTLSKILDALPSCERGRELKKDNCEQITAKMEQTKNKFCVLQKELSEAKEIKSQLENQKAKWEQELCSVRLTLNQEEEKRRNVDILKEKIRPEEQLRKKLEVKQQLEQTLRIQDIELKSVTSNLNQVSHTHESENDLFHENCMLKKEIAMLKLEVATLKHQHQVKENKYFEDIKILQEKNAELQMTLKLKQKTVTKRASQYREQLKVLTAENTMLTSKLKEKQDKEILETEIESHHPRLASALQDHDQSVTSRKNQELAFHSAGDAPLQGIMNVDVSNTIYNNEVLHQPLYEAQRKSKSPKINLNYAGDDLRENALVSEHAQRDRCETQCQMKKAEHMYQNEQDNVDKHTEQQESLEQKLFQLESKNRWLRQQLVYAHKKVNKSKVTINIQFPEMKMQRHLNEKNEEVFNYGNHLKERIDQYEKEKAEREVSIKKYKYFSNFLKESGLG

SEQ ID NO: 9176 - protein, 1392 aa, Homo sapiens
MKRLLAAAGKGVRGPEPPNPFSERVYTEKDYGTIYFGDLGKIHTAASRGQVQKLEKMTVGKKPVNLNKRDMKKRTALHWACVNGHAEVVTFLVDRKCQLNVLDGEGRTPLMKALQCEREACANILIDAGADLNYVDVYGNTALHYAVYSENLLMVATLLSYGAVIEVQNKASLTPLLLAIQKRSKQTVEFLLTKNANANAFNESKCTALMLAICEGSSEIVGMLLQQNVDVFAEDIHGITAERYAAACGVNYIHQQLLEHIRKLPKNPQNTNPEGTSTGTPDEAAPLAERTPDTAESLLEKTPDEAARLVEGTSAKIQCLGKATSGKFEQSTEETPRKILRPTKETSEKFSWPAKERSRKITWEEKETSVKTECVAGVTPNKTEVLEKGTSNMIACPTKETSTKASTNVDVSSVEPIFSLFGTRTIENSQCTKVEEDFNLATKIISKSAAQNYTCLPDATYQKDIKTINHKIEDQMFPSESKREEDEEYSWDSGSLFESSAKTQVCIPESMYQKVMEINREVEELPEKPSAFKPAVEMQKTVPNKAFELKNEQTLRAAQMFPSESKQKDDEENSWDSESPCETVSQKDVYLPKATHQKEFDTLSGKLEESPVKDGLLKPTCGRKVSLPNKALELKDRETFKAESPDKDGLLKPTCGRKVSLPNKALELKDRETLKAESPDNDGLLKPTCGRKVSLPNKALELKDRETFKAAQMFPSESKQKDDEENSWDFESFLETLLQNDVCLPKATHQKEFDTLSGKLEESPDKDGLLKPTCGMKISLPNKALELKDRETFKAEDVSSVESTFSLFGKPTTENSQSTKVEEDFNLTTKEGATKTVTGQQERDIGIIERAPQDQTNKMPTSELGRKEDTKSTSDSEIISVSDTQNYECLPEATYQKEIKTTNGKIEESPEKPSHFEPATEMQNSVPNKGLEWKNKQTLRADSTTLSKILDALPSCERGRELKKDNCEQITAKMEQTKNKFCVLQKELSEAKEIKSQLENQKAKWEQELCSVRLTLNQEEEKRRNVDILKEKIRPEEQLRKKLEVKQQLEQTLRIQDIELKSVTSNLNQVSHTHESENDLFHENCMLKKEIAMLKLEVATLKHQHQVKENKYFEDIKILQEKNAELQMTLKLKQKTVTKRASQYREQLKVLTAENTMLTSKLKEKQDKEILETEIESHHPRLASALQDHDQSVTSRKNQELAFHSAGDAPLQGIMNVDVSNTIYNNEVLHQPLYEAQRKSKSPKINLNYAGDDLRENALVSEHAQRDRCETQCQMKKAEHMYQNEQDNVDKHTEQQESLEQKLFQLESKNRWLRQQLVYAHKKVNKSKVTINIQFPEMKMQRHLNEKNEEVFNYGNHLKERIDQYEKEKAEREVSIKKYKYFSNFLKESGLG

SEQ ID NO: 9177 - protein, 619 aa, Homo sapiens
MKRLLAAAGKGVRGPEPPNPFSERVYTEKDYGTIYFGDLGKIHTAASRGQVQKLEKMTVGKKPVNLNKRDMKKRTALHWACVNGHAEVVTFLVDRKCQLNVLDGEGRTPLMKALQCEREACANILIDAGADLNYVDVYGNTALHYAVYSENLLMVATLLSYGAVIEVQNKASLTPLLLAIQKRSKQTVEFLLTKNANANAFNESKCTALMLAICEGSSEIVGMLLQQNVDVFAEDIHGITAERYAAACGVNYIHQQLLEHIRKLPKNPQNTNPEGTSTGTPDEAAPLAERTPDTAESLLEKTPDEAARLVEGTSAKIQCLGKATSGKFEQSTEETPRKILRPTKETSEKFSWPAKERSRKITWEEKETSVKTECVAGVTPNKTEVLEKGTSNMIACPTKETSTKASTNVDVSSVEPIFSLFGTRTIENSQCTKVEEDFNLATKIISKSAAQNYTCLPDATYQKDIKTINHKIEDQMFPSESKREEDEEYSWDSGSLFESSAKTQVCIPESMYQKVMEINREVEELPEKPSAFKPAVEMQKTVPNKAFELKNEQTLRAAQMFPSESKQKDDEENSWDSESPCETVSQKDVYLPKATHQKEFDTLSGKLEAYLWKESFSSK

SEQ ID NO: 9178 - protein, 1873 aa, Homo sapiens
MEEGVQAPDWDSDETVIEGSVTESDLEEKELPWRRLLFDQDASLKSEFSLHPDTRGMCKGMPSPEIQLGFKLREDLQEQMNKNKMMPVLSEDTILQSQDETERNQALLQTRKNCSMFIGSFRQSGLSLNHQNIEGPEAESPEVLPHIEKELSEGRDSPEVSLLSGTAITVSDTVAVKETSLVEPEKILAAPNTFFEPRKEVTMTMTSEETKDEESSLETFVSALESLLTSPESTQEERLFELVSDFDRKELMNPLSDSLSSISIPLNSWSACHRDLLEDAKDDALPAELLEALNTLSEAKVETICHRKEGGSSLIARNECLEVEFNTSQTNEDCTQIAETLQDPNPSGLQTLAHQNITSCEPLSNKRNSNSVTNSSDQETACVLRRSSRLEKLKVSRDAKYSDHMYKMPEKILPKILGCEDLTNNNSSAQNFRMQDPALMIDGKEKNMHSARFKNGKQIRKNEQFSGKKEKMKVNKISLHSINRRNIFGENLVYKAALHDDADLVHHCIKKGGNVNQPSYAGWTALHEASVGGFYRTASELLKGGADVNIKGLYQITPLHDAVMNGHYKVAELLLLNGADPLFRNDDGKCALDEAKDLCMKRLLERYIPKHQKCLTSAQRSSIDPLDIEDVYQHKKPKFSSKSHIWHVYNENSNRQKLEHVKVNKGSKASLFINKEDVYEYYQKDPKNTKFGKSKHKQSTLDQIYSTGLRKGNLHNVKDPNTNVPKGIGRRKTQHKRTQVDDVDCNPRKILAVSPSRRINRLVTYQQHIPETHNDLPEELCEPSSLTLSSLRNGLDSSTEACSVSKEKHIQNLDLSDSQEVQCLELESVDQTEAVSFPGLLLHKEIKLPVVTTDKQPHTLQEQHHVLYKSHENSNLVPKDERFNKWENSFLSFVKENSDNDDDDDCSTSEKAITSKKVLCSTGGKKHYNFKENLTNKKEMGFQQFLLSEDHLSQENELKAVSLTTLPEQEAVNFSYSDNAVISEHVANYEQCIFGPSFDHSNGNPEQNSLACMRTLLTHEASKLTNHVELFKKPQDYIPRAPTFLMNQTDTHIVEKMAKNCDTERNYIDRDQKIIYSNEPLSIVAHSQVIETTKVEKRRQNHLESETIHNIDSHSTDNMSKELANISKLSQREKKEISHKPGMKAGRINKRNARGESQLHLAVRRGNLPLVKALIESGADVNLNDNAGWTPLHEASNEGSIDIIVELLKAGAKVNCENIDGILPLHDAVANNHLKAAEILLQNGANPNQKDQKQKSALDEADDEKMKELLRSYGAIETVNRDESDAIVNEKIPAVRSKRHKQCFCDDGKTIDSSSLSHQERSRESLSVHQTLSAILQDIEEKQEYLLEFEIRNPEDAEQYIEKMLKIKKIMDNVLAKQKAERDDLAKKYRVSIESFKHGALREQLANLAARQKSLLVVAKKQKKISLKIQNCRNVTSLPCLSLRKLPPRSEISSEKDSQELTSLENLEHPQSGSLSPVSGSMQETQLSLETWNYSQNTNICLNSEAVRRGEFSGNDMNSKQNGSDCTLDGFPKSRHSDGTEKNKLPSQPVAFIGQTEYSQKENDLTEATDKDHEFYVSSPVIGKLNISETASVLAENAAHPSNIICDQDLSNYDPKRGNRKTSSQQSPTGASESLAHQGIAVLGSDTVHQMKPYLKKSVSVVPCADDSQISSSSGSGQQDTIKKALNYSTAPKKKCIQIKDLILLGRINPGNNILEFKTQETTHKASILLNGKLKVESGQIYKNPVTWLKDLLGGNSYVTWNYAWSKVTYLGKELLRYVSEDAPILPEPNSVPQQYQPCLPEVACLDDPVQEPNKSMFEKTKFGQGTSRESMQSSPRYLQINEILLISDQEFLPCHIMDQHWKFCVECEELTP

SEQ ID NO: 9179 - protein, 272 aa, Homo sapiens
MVACYHGFQSVVALLSHCPFLDVNQQDKGGDTALMLAAQAGHVPLVSLLLNYYVGLDLERRDQRGLTALMKAAMRNRCECVATLLMAGADLTAVDPVRGKTALEWAVLTDSFDTVWRIRQLLRRPQVEQLSQHYKPEWPALSGLVAQAQAQAQVAPSLLERLQATLSLPFAPSPQEGGVLDHLVTATTSLASPFVTTACHTLCPDHPPSLGTRSKSVPELLVPAEAQSFRTPKSGPSSLAIPGAQDREEETGGGGQNGTEVGEDGIGQAGNR

SEQ ID NO: 9180 - protein, 203 aa, Homo sapiens
MKAAMRNRCECVATLLMAGADLTAVDPVRGKTALEWAVLTDSFDTVWRIRQLLRRPQVEQLSQHYKPEWPALSGLVAQAQAQAQVAPSLLERLQATLSLPFAPSPQEGGVLDHLVTATTSLASPFVTTACHTLCPDHPPSLGTRSKSVPELLVPAEAQSFRTPKSGPSSLAIPGAQDREEETGGGGQNGTEVGEDGIGQAGNR

SEQ ID NO: 9181 - protein, 494 aa, Homo sapiens
MVLLAGTGPEGGGARCMTPPPPSPPRGAQVEEDPADYEEFEDFSSLPDTRSIASDDSFYPFEDEEEHGVESAESVPEGVPESVPETATLLRAACANNVGLLRTLVRRGVSVEEAQETDRNGRTGLIVACYHGFVDTVVALAECPHVDVNWQDSEGNTALITAAQAGHAIITNYLLNYFPGLDLERRNAFGFTALMKAAMQGRTDCIRALMLAGADVHARDPRRGMSPQEWATYTGRVDAVRLMQRLLERPCPEQFWEKYRPELPPPPEAARKPAGSKNCLQRLTDCVLSVLTPRSVRGPEDGGVLDHMVRMTTSLYSPAVAIVCQTVCPESPPSVGKRRLAVQEILAARAARGPQAQEEDEVGGAGQRGRTGQEDADSREGSPRAGLPPALGSRGPAAPAPRKASLLPLQRLRRRSVRPGVVVPRVRVSKAPAPTFQPERPARKGSTKDSGHLQIPKWRYKEAKEEKRKAEEAEKKRQAEAQKERRTAPWKKRT

SEQ ID NO: 9182 - protein, 496 aa, Homo sapiens
MLHTEGHALLRAVGQGKLRLARLLLEGGAYVNEGDAQGETALMAACRARYDDPQNKARMVRYLLEQGADPNIADRLGRTALMHACAGGGGAAVASLLLAHGADPSVRDHAGASALVHALDRGDRETLATLLDACKAKGTEVIIITTDTSPSGTKKTRQYLNSPPSPGVEDPAPASPSPGFCTSPSEIQLQTAGGGGRGMLSPRAQEEEEKRDVFEFPLPKPPDDPSPSEPLPKPPRHPPKPLKRLNSEPWGLVAPPQPVPPTEGRPGIERLTAEFNGLTLTGRPRLSRRHSTEGPEDPPPWAEKVTSGGPLSRRNTAPEAQESGPPSGLRQKLSRMEPVELDTPGHLCPDSPESSRLSLERRRYSASPLTLPPAGSAPSPRQSQESLPGAVSPLSGRRRSPGLLERRGSGTLLLDHISQTRPGFLPPLNVSPHPPIPDIRPQPGGRAPSLPAPPYAGAPGSPRTKRKLVRRHSMQTEQIRLLGGFQSLGGPGEPGR

SEQ ID NO: 9183 - protein, 535 aa, Homo sapiens
MMDDDTELRTDGNSLLKAVWLGRLRLTRLLLEGGAYINESNDKGETALMVACITKHVDQQSISKSKMVKYLLDNRADPNIQDKSGKTALIHACIRRAGGEVVSLLLENGADPSLEDRTGASALVYAINADDKDALKHLLDACKAKGKEVIIITTDKSSSGTKTTKQYLNVPPSPKVEDRHSPPLCASPSDIELKALGLDSPLTEKEDDFFSLQAGHPSSCNTSKAVNEPGSPTRKVSNLKRARLPQLKRLQSEPWGLIAPSVLAASTRQDETHGASTDNEVIKSISDISFPKRGPLSRTNSIDSKDPTLFHTVTEQVLKIPVSSAPASWKAAYEKGQAPHPRLARRGTLPVDQEKCGMGPSGPSALKEPASLKWLENDLYDLDIQPGPDPPNSISLESGKGPLDRKKLNSSHLSLFHGSRESLDTVPSTSPSSARRRPPHLLERRGSGTLLLDRISHTRPGFLPPLNVNLNPPIPDIRSSSKPSCSLASGLKSMVPVAPSSPKRVDLRSKKKLLRRHSMQIEQMKQLSDFEEIMT

SEQ ID NO: 9184 - protein, 1001 aa, Homo sapiens
MKRIFSCSSTQVAVERWNRHDQKLLEAVHRGDVGRVAALASRKSARPTKLDSNGQSPFHLAASKGLTECLTILLANGADINSKNEDGSTALHLATISCQPQCVKVLLQHGANEDAVDAENRSPLHWAASSGCASSVLLLCDHEAFLDVLDNDGRTPLMIASLGGHAAICSQLLQRGARVNVTDKNDKSALILACEKGSAEVAELLLSHGADAGAVDSTGHDALHYALHTQDKALWRHLQQALSRRRRGGQRLVQHPDLASQASPSEPQAGSPPKSSWRAEPEEEQEEKEDEDPCSEEWRWKYEEERRKVVRLEQELVQKTEECKTQAAAYLDLENQIREQAQELGVLLSWEPRASGKQGSSLRPGGDGMEQGCPKDLLAESTQELKKQQQAAATVNPVLAPKKAEDSAPGKIQYEVHGRSQPEEQGPPQSPASETIRKATGQQLTTNGAQTFGPDHADQLPAGQKESSQVLGVEPGGTVAEPVGPAAMNQLLLQLREELAAVWREKDAARGALSRPVMEGALGTPRAEAAAAAWEKMEARLERVLARLEWAKAGLQVKPEVPSQESREGALKAAPGSIKQDEEKEKRVPGARGEPLGALGGEKALGGLAKGQLEKEMSVLRLSNSNLLEELGELGRERQRLQRELQSLSQRLQREFVPKPEAQVQLQQLRQSVGLLTNELAMEKEATEKLRKLLASQSSGLRGLWDCLPADLVGERSAQSKAAESLEELRACISTLVDRHREAQQVLARLQEENQQLRGSLSPCREPGTSLKAPASPQVAALEQDLGKLEEELRAVQATMSGKSQEIGKLKQLLYQATEEVAELRAREAASLRQHEKTRGSLVAQAQAWGQELKALLEKYNTACREVGRLREAVAEERRRSGDLAAQAAEQERQASEMRGRSEQFEKTAELLKEKMEHLIGACRDKEAKIKELLKKLEQLSEEVLAIRGENARLALQLQDSQKNHEEIISTYRNHLLNAARGYMEHEVYNILLQILSMEEE

SEQ ID NO: 9185 - protein, 910 aa, Homo sapiens
MKRIFSCQPQCVKVLLQHGANEDAVDAENRSPLHWAASSGCASSVLLLCDHEAFLDVLDNDGRTPLMIASLGGHAAICSQLLQRGARVNVTDKNDKSALILACEKGSAEVAELLLSHGADAGAVDSTGHDALHYALHTQDKALWRHLQQALSRRRRGGQRLVQHPDLASQASPSEPQAGSPPKSSWRAEPEEEQEEKEDEDPCSEEWRWKYEEERRKVVRLEQELVQKTEECKTQAAAYLDLENQIREQAQELGVLLSWEPRASGKQGSSLRPGGDGMEQGCPKDLLAESTQELKKQQQAAATVNPVLAPKKAEDSAPGKIQYEVHGRSQPEEQGPPQSPASETIRKATGQQLTTNGAQTFGPDHADQLPAGQKESSQVLGVEPGGTVAEPVGPAAMNQLLLQLREELAAVWREKDAARGALSRPVMEGALGTPRAEAAAAAWEKMEARLERVLARLEWAKAGLQVKPEVPSQESREGALKAAPGSIKQDEEKEKRVPGARGEPLGALGGEKALGGLAKGQLEKEMSVLRLSNSNLLEELGELGRERQRLQRELQSLSQRLQREFVPKPEAQVQLQQLRQSVGLLTNELAMEKEATEKLRKLLASQSSGLRGLWDCLPADLVGERSAQSKAAESLEELRACISTLVDRHREAQQVLARLQEENQQLRGSLSPCREPGTSLKAPASPQVAALEQDLGKLEEELRAVQATMSGKSQEIGKLKQLLYQATEEVAELRAREAASLRQHEKTRGSLVAQAQAWGQELKALLEKYNTACREVGRLREAVAEERRRSGDLAAQAAEQERQASEMRGRSEQFEKTAELLKEKMEHLIGACRDKEAKIKELLKKLEQLSEEVLAIRGENARLALQLQDSQKNHEEIISTYRNHLLNAARGYMEHEVYNILLQILSMEEE

SEQ ID NO: 9186 - protein, 137 aa, Homo sapiens
MKRIFSCSSTQVAVERWNRHDQKLLEAVHRGDVGRVAALASRKSARPTKLDSNGQSPFHLAASKGLTECLTILLANGADINSKNEDGSTALHLATISCQPQCVKVLLQPPLAVPQVCSCCVTTKPSWTCWIMMDVHP

SEQ ID NO: 9187 - protein, 162 aa, Homo sapiens
MEDGKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKAVQLRQEACATLLLQNGANPNITDFFGRTALHYAVYNEDTSMIEKLLSHGTNIEECSK

SEQ ID NO: 9188 - protein, 127 aa, Homo sapiens [sequence omitted]

SEQ ID NO: 9189 - protein, 346 aa, Homo sapiens
MEDGKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKAVQLRQEACATLLLQNGANPNITDFFGRTALHYAVYNEDTSMIEKLLSHGTNIEECSKCEYQPLLFAVSRRKVKMVEFLLKKKANVNAIDYLGRSALIHAVTLGEKDIVILLLQHNIDVLSRDAFRKIAGDYAIEAKNRVIFDLIYEYERKRYEDLPINSNPVSSQKPPTLKGTSDEEDSVLGIARENKDGEKSRTVSSEKPPGLKASSAEKDSVLNIARGKKDGEKTKRVSSRKKPSLEAT

SEQ ID NO: 9190 - protein, 1941 aa, Homo sapiens
MEDGKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKAVQLRQEACATLLLQNGANPNITDFFGRTALHYAVYNEDTSMIEKLLSHGTNIEECSKCEYQPLLFAVSRRKVKMVEFLLKKKANVNAIDYLGRSALIHAVTLGEKDIVILLLQHNIDVLSRDAFRKIAGDYAIEAKNRVIFDLIYEYERKRYEDLPINSNPVSSQKQPALKATSGKEDSISNIATEIKDGQKSGTVSSQKQPALKDTSDKDDSVSNTATEIKDEQKSGTVLPAVEQCLNRSLYRPDAVAQPVTENEFSLESEIISKLYIPKRKIISPRSIKDVLPPVEEAVDRCLYLLDRFAQPVTKDKFALESENISEPYFTNRRTISQQSAENLDAACGIDKTENGNMFEDQNVDKEGKALPATGQKANVSPEQPPLFTHTVKDRDHISTRFLGGMDSLTSSEESSERPPLSTLTLKEADPSSKAAMRRKDSPPPGKVSSQKQPAEKATSDDKDSVSNIATEIKEGPISGTVSSQKQPAEKATSDEKDSVSNIATEIKKGQQSGTVSPQKQSAWKVIFKKKVSLLNIATRIMGGGKSGTVSSQKQPASKATSDKTDSALNIATEIKDGLQCGTVSSQKQPALKATTDEEDSVSNIATEIKDGEKSGTVSSQKQPALKATTDEEDSVSNIATEIKDGEKSGTVSSQKQPALKATTDEKDSVSNIATEIKDGEKSGTVSSQKPPALTATSDEEGSVLSIARENKDGEKSRTVSSRKKPALKATSDEKDSFSNITRGKKDGEISRKVSSQKPPTLKGTSDEEDSVLGIARENKDGEKSRTVSSEKPPGLKASSAEKDSVLNIARGKKDGEKTKRVSSRKKPSLEATSDEKDSFSNITREKKDGEISRKVSSQKPPALKGTSDEEDSVLGIARENKDGEKSRTVSSEKPPGLKATSDEKDSVLNIARGKKDGEKTRTVSSQKPPTLKATSDEEDSVLSIARENKDGEKSRTVSSEKPSGLKATSAEKDSVLNIARGKKYGEKTKRVSSRKKPALKATSDEKDSVLYIAREKKDGEKSRTVSSPKQPALKAICDKEDSVPNMATEKKDEQISGTVSCQKQPALKATSDKKDSVSNIPTEIKDGQQSGTVSSQKQPAWKATSVKKDSVSNIATEIKDGQIRGTGILEYTFNVMFDQIEEKFTSLNKSAGVSPQKQSAQKVIFKKKVSLLNIATRITGGWKSGTEYPENLPTLKATIENKNSVLNTATKMKDVQTSTPAEQDLEMASEGEQKRLEEYENNQPQVKNQIHSRDDLDDIIQSSQTVSEDGDSLCCNCKNVILLIDQHEMKCKDCVHLLKIKNTFCLWKRLIKLKDNHCEQLRVKIRKLKNKASVLQKRISEKEEIKSQLKHEILELEKELCSLRFAIQQEKKKRRNVEEVHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYHCRLNAARCDHDQSHSSKRDQELAFQGTVDKCRHLQENLNSHVLILSLQLSKAESKSRVLKTELHYTGEALKEKALVFEHVQSELKQKQSQMKDIEKMYKSGYNTMEKCIEKQERFCQLKKQNMLLQQQLDDARNKADNQEKAILNIQARCDARVQNLQAECRKHRLLLEEDNKMLVNELNHSKEKECQYEKEKAEREVAVRQLQQKRDDVLNKGSATKALLDASSRHCTYLENGMQDSRKKLDQMRSQFQEIQDQLTATIRCTKEMEGDTQKLEVEHVMMRKIIKKQDDQIERLEKILQHSSLMLQVFES

SEQ ID NO: 9191 - protein, 309 aa, Homo sapiens [sequence omitted]

SEQ ID NO: 9192 - protein, 1941 aa, Homo sapiens; identical to SEQ ID NO: 9190

SEQ ID NO: 9193 - protein, 1208 aa, Homo sapiens
MGGGKSGTVSSQKQPASKATSDKTDSALNIATEIKDGLQCGTVSSQKQPALKATTDEEDSVSNIATEIKDGEKSGTVSSQKQPALKATTDEEDSVSNIATEIKDGEKSGTVSSQKQPALKATTDEKDSVSNIATEIKDGEKSGTVSSQKPPALTATSDEEGSVLSIARENKDGEKSRTVSSRKKPALKATSDEKDSFSNITRGKKDGEISRKVSSQKPPTLKGTSDEEDSVLGIARENKDGEKSRTVSSEKPPGLKASSAEKDSVLNIARGKKDGEKTKRVSSRKKPSLEATSDEKDSFSNITREKKDGEISRKVSSQKPPALKGTSDEEDSVLGIARENKDGEKSRTVSSEKPPGLKATSDEKDSVLNIARGKKDGEKTRTVSSPKQPALKAICDKEDSVPNMATEKKDEQISGTVSCQKQPALKATSDKKDSVSNIPTEIKDGQQSGTVSSQKQPAWKATSVKKDSVSNIATEIKDGQIRGTVSPQVPIPRHKVGNIKSYPNTGRRIQLDANTFSVSPQKQSAQKVIFKKKVSLLNIATRITGGWKSGTEYPENLPTLKATIENKNSVLNTATKMKDVQTSTPAEQDLEMASEGEQKRLEEYENNQPQVKNQIHSRDDLDDIIQSSQTVSEDGDSLCCNCKNVILLIDQHEMKCKDCVHLLKIKNTFCLWKRLIKLKDNHCEQLRVKIRKLKNKASVLQKRISEKEEIKSQLKHEILELEKELCSLRFAIQQEKKKRRNVEEVHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYHCRLNAARCDHDQSHSSKRDQELAFQGTVDKCRHLQENLNSHVLILSLQLSKAESKSRVLKTELHYTGEALKEKALVFEHVQSELKQKQSQMKDIEKMYKSGYNTMEKCIEKQERFCQLKKQNMLLQQQLDDARNKADNQEKAILNIQARCDARVQNLQAECRKHRLLLEEDNKMLVNELNHSKEKECQYEKEKAEREVAVRQLQQKRDDVLNKGSATKALLDASSRHCTYLENGMQDSRKKLDQMRSQFQEIQDQLTATIRCTKEMEGDTQKLEVEHVMMRKIIKKQDDQIERLEKILQHSSLLLLNFET

SEQ ID NO: 9194 - protein, 606 aa, Homo sapiens
SSRKKPALKATSDEKDSFSNITREKKDGETSRTVSSQKPPALKATSDEEDSVLSIAREEKDGEKSRTVSSEQPPGLKATRDEKDSLLNIARVIQAGGQSFSVSSRKKAALKATSDEKDSFSNITRERKDGETSRTVSSQKPPALKATSDEEDSVLNIAREKKDGEKSRTVSSRKKAALKATSDEKDSFSNITRERKDGETSRTVSSQKPPALKATSDEEDSVLNIAREKKDGEKSRTVSSEQPPGLKATRDEKDSLLNIARGKKHGEKTRRVSSRKKAALKATSDEKDSFSNITRERKDGETSRTVSSQKPPALKATGDEEDSVLNIAREKKDGEKSRTVSSEKPSGLKATSDEKDSVLNIARGKKHGEKTRRVSSHKQPALKATSDKENSVPNMATETKDEQISGTVSSQKQPALKATSDKKDSVSNIPTEIKDGQQSGTVSSQKQLAWKATSVKKDSVSNIATEIKDGQIRGTVSSQRQPALKATGDEKDSVSNIAREIKDGEKSGTVSPQKQSAQKVIFKKKVSLLNIATRITGGWKSGTEYPENLPTLKATIENKNSVLNTATKMKDVQTSTPEQDLEMASEGEQKRLEEYENNQPQVYFSF

SEQ ID NO: 9195 - protein, 799 aa, Homo sapiens
MATETKDEQISGTVSSQKQPALKATSDKKDSVSNIPTEIKDGQQSGTVSSQKQLAWKATSVKKDSVSNIATEIKDGQIRGTVSSQRQPALKATGDEKDSVSNIAREIKDGEKSGTVSPQKQSAQKVIFKKKVSLLNIATRITGGWKSGTEYPENLPTLKATIENKNSVLNTATKMKDVQTSTPEQDLEMASEGEQKRLEEYENNQPQVKNQIHSRDDLDDIIQSSQTVSEDGDSLCCNCKNVILLIDQHEMKCKDCVHLLKIKKTFCLCKRLTELKDNHCEQLRVKIRKLKNKASVLQKRLSEKEEIKSQLKHETLELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNEETLAETIACYSGQLAALTDENTTLRSKLEKQRESGQRLETEMQSYRCRLNAALCDHDQSHSSKRDQELAFQGTVDKCCHLQENLNSHVLILSLQLSKAESKFRVLETELHYTGEALKEKALVFEHVQSELKQKQSQMKDIEKMYKSGYNTMEKCIEKQERFCQLKKQNMLLQQQLDDARNKADNQEKAILNIQARCDARVENLQAECRKHRLLLEEDNKMLVNELNHSKEKKCQYEKEKAEREVAVRQLQQKQDDVLNKRSATKALLDASSRHCIYLENGMQDSRKKLDQMRSQFQEIQDQLTATIRCTKEMEGDAQKLEVENVMMRKIIKKQDEQIERFEKILQHSSLV

SEQ ID NO: 9196 - protein, 1029 aa, Homo sapiens
SSRKKAALKATSDEKDSFSNITRERKDGETSRTVSSQKPPALKATSDEEDSVLNIAREKKDGEKSRTVSSEQPPGLKATRDEKDSLLNIARGKKHGEKTRRVSSRKKAALKATSDEKDSFSNITRERKDGETSRTVSSQKPPALKATGDEEDSVLNIAREKKDGEKSRTVSSEKPSGLKATSDEKDSVLNIARGKKHGEKTRRVSSHKQPALKATSDKENSVPNMATETKDEQISGTVSSQKQPALKATSDKKDSVSNIPTEIKDGQQSGTVSSQKQLAWKATSVKKDSVSNIATEIKDGQIRGTVSSQRQPALKATGDEKDSVSNIAREIKDGEKSGTVSPQKQSAQKVIFKKKVSLLNIATRITGGWKSGTEYPENLPTLKATIENKNSVLNTATKMKDVQTSTPEQDLEMASEGEQKRLEEYENNQPQVKNQIHSRDDLDDIIQSSQTVSEDGDSLCCNCKNVILLIDQHEMKCKDCVHLLKIKKTFCLCKRLTELKDNHCEQLRVKIRKLKNKASVLQKRLSEKEEIKSQLKHETLELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNEETLAETIACYSGQLAALTDENTTLRSKLEKQRESGQRLETEMQSYRCRLNAALCDHDQSHSSKRDQELAFQGTVDKCCHLQENLNSHVLILSLQLSKAESKFRVLETELHYTGEALKEKALVFEHVQSELKQKQSQMKDIEKMYKSGYNTMEKCIEKQERFCQLKKQNMLLQQQLDDARNKADNQEKAILNIQARCDARVENLQAECRKHRLLLEEDNKMLVNELNHSKEKKCQYEKEKAEREVAVRQLQQKQDDVLNKRSATKALLDASSRHCIYLENGMQDSRKKLDQMRSQFQEIQDQLTATIRCTKEMEGDAQKLEVENVMMRKIIKKQDEQIERFEKILQHSSLVSIIFET

SEQ ID NO: 9197 - protein, 1778 aa, Homo sapiens
MDDKEPKRWPTLRDRLCSDGFLFPQYPIKPYHLKGIHRAVFYRDLEELKFVLLTRYDINKRDRKERTALHLACATGQPEMVHLLVSRRCELNLCDREDRTPLIKAVQLRQEACATLLLQNGADPNITDVFGRTALHYAVYNEDTSMIEKLLSYGANIEECSEDEYPPLFLAVSQRKVKMVEFLLKKKANINAVDYLGRSALIHAVTLGEKDIVILLLQHNIDVFSRDVYGKLAEDYASEAKNRVIFELIYEYERKKHEELSINSNPVSSQKQPALKATSGKEDSISNIATEIKDGQKSGTVSSQKQPALKGTSDKNDSVSNTATEIKDEQKSGTVSSQKQPALKDTSDKNDSVSNTATEIKDEQKSGTVLPAVEQCLNRSLYRPDAVAQPVTEDEFALESEIISKLYIPKRKIISPRSIEDVLPPVEEAVDRCLYLLDRFAQAVTKDKFALESENISEPYFTNRRTISQQSAEKLDAACGIDKTENGTLFEDQNVDKEGKALPATGQKANVSPEQPPLFTHTVKDSDHISTRFLGSMDSLTSSEESSERPPLSTLTLKEADPSSKAAMRRKDSPPPGKVSSQKQPAEKATSDDKDSVSNIATEIKEGPISGTVSSQKQPAEKATSDEKDSVSNIATEIKEGQQSGTVSPQKQSAWKVIFKKKVSLLNIATRITGGGKSGTVSSQKQPPSKATSDKTDSALNIATEIKDGLQCGTVSSQKQPALKATTDEEDSVSNIATEIKDGEKSGTVSSQKQPALKATTDEEDSVSIIATEIKDGEKSGTVSSRKKPALKATSDEKDSFSNITREKKDGEISRTVTSEKPAGLKATSDEEDSVLNIARGKEDGEKTRRVSSRKKPALKATSDEKDSFSNITREKKDGETSRTVSSQKPPALKATSDEEDSVLNIAREKKDGEKSRTVSSEKPSGLKATSDEKDSVLNIARGKKHGEKTRRVSSHKQPALKATSDKENSVPNMATETKDEQISGTVSSQKQPALKATSDKKDSVSNIPTEIKDGQQSGTVSSQKQLAWKATSVKKDSVSNIATEIKDGQIRGTVSSQRQPALKATGDEKDSVSNIAREIKDGEKSGTVSPQKQSAQKVIFKKKVSLLNIATRITGGWKSGTEYPENLPTLKATIENKNSVLNTATKMKDVQTSTPEQDLEMASEGEQKRLEEYENNQPQVKNQIHSRDDLDDIIQSSQTVSEDGDSLCCNCKNVILLIDQHEMKCKDCVHLLKIKKTFCLCKRLTELKDNHCEQLRVKIRKLKNKASVLQKRLSEKEEIKSQLKHETLELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNEETLAETIACYSGQLAALTDENTTLRSKLEKQRESGQRLETEMQSYRCRLNAALCDHDQSHSSKRDQELAFQGTVDKCCHLQENLNSHVLILSLQLSKAESKFRVLETELHYTGEALKEKALVFEHVQSELKQKQSQMKDIEKMYKSGYNTMEKCIEKQERFCQLKKQNMLLQQQLDDARNKADNQEKAILNIQARCDARVENLQAECRKHRLLLEEDNKMLVNELNHSKEKKCQYEKEKAEREVAVRQLQQKQDDVLNKRSATKALLDASSRHCIYLENGMQDSRKKLDQMRSQFQEIQDQLTATIRCTKEMEGDAQKLEVENVMMRKIIKKQDEQIERFEKILQHSSLMLQVFES

SEQ ID NO: 9198 - protein, 183 aa, Homo sapiens
MATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHKAAERGHGDICSLLLQHSPALKAIRDRKARLACDLLPCNSDLRDLLSS

SEQ ID NO: 9199 - protein, 368 aa, Homo sapiens
MNALLEQKEQQERLREAAALGDIREVQKLVESGVDVNSQNEVNGWTCLHWACKRNHGQVVSYLLKSGADKEILTTKGEMPVQLTSRREIRKIMGVEEEDDDDDDDDNLPQLKKESELPFVPNYLANPAFPFIYTPTAEDSAQMQNGGPSTPPASPPADGSPPLLPPGEPPLLGTFPRDHTSLALVQNGDVSAPSAILRTPESTKPGPVCQPPVSQSRSLFSSVPSKPPMSLEPQNGTYAGPAPAFQPFFFTGAFPFNMQELVLKVRIQNPSLRENDFIEIELDRQELTYQELLRVCCCELGVNPDQVEKIRKLPNTLLRKDKDVARLQDFQELELVLMISENNFLFRNAASTLTERPCYNRRASKLTY

SEQ ID NO: 9200 - protein, 258 aa, Homo sapiens
GETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARMRAYKKIVELRHLLEIAESNYKHLGGITEEDLKQKKEQLESEKTIKELQGQLEYERLRREKLECQLDEYRAEVDQLRETLEKIQVPNFVAMEDSASCESNKEKRRVKKKVSSGGVFVRRY

SEQ ID NO: 9201 - protein, 198 aa, Homo sapiens
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPEPP

SEQ ID NO: 9202 - protein, 389 aa, Homo sapiens
MPGVANSGPSTSSRETANPCSRKKVHFGSIHDAVRAGDVKQLSEIVCLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARRPSKNCRASWSMNDYVEKN

SEQ ID NO: 9203 - protein, 591 aa, Homo sapiens
SFPRRRPCCLSSQVAGVGRLERDSEKVPAEGGRRYGDSQGVADEDGGRRTSHHVWRINGLHGHSGAESRERVSDDGERKCEESDRRSRVAAGSLSADAGFSRSDLRRVSENLGHCRSVSRERVRGDSGHSHSCSWERVRGDSTFCSSDVNFSEVGGHQTTDSRGTAREDRGLRLSGPWEGVSDIRDPRTSDFGDRVSDDRSRRFSGSWEGGSVEGGHSVGSSWEEVSGDRGYAASDSSGVSGSEDASYRFSGFWERESEDEGFRCSFWERAREDLGPRPSDDGEEGRCRCSGSWVRASEDRRSIRGLDSTPPQSRRCCAMPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGSPKPATDLQGETGATELAPRES

SEQ ID NO: 9204 - protein, 549 aa, Homo sapiens
MALAAAAAAAAAGVSQAAVLGFLQEHGGKVRNSELLSRFKPLLDAGDPRGRAARRDRFKQFVNNVAVVKELDGVKFVVLRKKPRPPEPEPAPFGPPGAAAQPSKPTSTVLPRSASAPGAPPLVRVPRPVEPPGDLGLPTEPQDTPGGPASEPAQPPGERSADPPLPALELAQATERPSADAAPPPRAPSEAASPCSDPPDAEPGPGAAKGPPQQKPCMLPVRCVPAPATLRLRAEEPGLRRQLSEEPSPRSSPLLLRRLSVEESGLGLGLGPGRSPHLRRLSRAGPRLLSPDAEELPAAPPPSAVPLEPSEHEWLVRTAGGRWTHQLHGLLLRDRGLAAKRDFMSGFTALHWAAKSGDGEMALQLVEVARRSGAPVDVNARSHGGYTPLHLAALHGHEDAAVLLVVRLGAQVHVRDHSGRRAYQYLRPGSSYALRRLLGDPGLRGTTEPDATGGGSGSLAARRPVQVAATILSSTTSAFLGVLADDLMLQDLARGLKKSSSFSKFLSASPMAPRKKTKIRGGLPAFSEISRRPTPGPLAGLVPSFPPTT

SEQ ID NO: 9205 - protein, 985 aa, Homo sapiens
QPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENASRSNGPRSTPGTAVQKEE

SEQ ID NO: 9206 - protein, 919 aa, Homo sapiens
MLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQT

SEQ ID NO: 9207 - protein, 919 aa, Homo sapiens
LLIYKTEIISTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQT

SEQ ID NO: 9208 - protein, 579 aa, Homo sapiens
MAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELVSCFVLFSLTHTHTHTPNHRGINCFFPEL

SEQ ID NO: 9209 - protein, 367 aa, Homo sapiens
MAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAK

SEQ ID NO: 9210 - protein, 919 aa, Homo sapiens; identical to SEQ ID NO: 9206

SEQ ID NO: 9211 - protein, 507 aa, Homo sapiens
MWLTPLHRAVASRSEEAVQVLIKHSADVNARDKNWQTPLHVAAANKAVKCAEVIIPLLSSVNVSDRGGRTALHHAALNGHVEMVNLLLAKGANINAFDKKDRRALHWAAYMGHLDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELVSCFVLFSLTHTHTHTPNHRGINCFFPEL

SEQ ID NO: 9212 - protein, 266 aa, Homo sapiens
MESEGPPESESSEFFSQQEEENEEEEAQEPEETGPKNPLLQPALTGDVEGLQKIFEDPENPHHEQAMQLLLEEDIVGRNLLYAACMAGQSDVIRALAKYGVNLNEKTTRGYTLLHCAAAWGRLETLKALVELDVDIEALNFREERARDVAARYSQTECVEFLDWADARLTLKKYIAKVSLAVTDTEKGSGKLLKEDKNTILSACRAKNEWLETHTEASINELFEQRQQLEDIVTPIFTKMTTPCQVKSAKSVTSHDQKRSQDDTSN

SEQ ID NO: 9213 - protein, 776 aa, Homo sapiens
MALADKRLENLQIYKVLQCVRNKDKKQIEKLTKLGYPELINYTEPINGLSALHLASVSNDIDMVSFLLDLGAHPDVQDRMGCTPTMRAAELGHELSMEILAKAKADMTIVDNEGKGVLFYCILPTKRHYRCALIALEHGADVNNSTYEGKPIFLRACEDAHDVKDVCLTFLEKGANPNAINSSTGRTALMEASREGVVEIVRGILERGGEVNAFDNDRHHAAHFAAKGGFFDILKLLFAYNGDVGLISINGNTPLHYAAMGGFADCCKYIAQRGCDLKWKNLDHKTPRAVAKEGGFKAASKEIRRAERIANKLARPGAKNPNPLWALRLHDWSVEREAFLREAFAVLDRGDGSISKNDFVMVLEERQDYASSEQLAAIAHLHEKTRGGGVNINEFFKGTRYLNKSFVLGSYGPKKKEKGMGKKGKKGKFVLPLPICVIPEYAFPRRQDGGPPYYMIETYKNVTDSSRFNRDHPPEHPIQDDSVWYIDDSEKVFSNINIITKAGDLASLKKAFESGIPVDMKDNYYKTPLMTACASGNIDVVKFLLEKGANVNATDNFLWTPLHFACHAGQQDIVELLVESGALIDAASINNSTPLNRAIESCRLDTVKYLLDIGAKFQLENRKGHSAMDVAKAYADYRIIDLIKEKLDNLPKPAENQKLKGKTPPILKTEGPEIKKEEELLSSIYGVPTTSEGKKVQKGNVVHLNSLITSGYTKKVDITFIPRRIWSPEATTAELIRKRELRRERFTHEVDFDDFMMPFQKNITEKARALEAALKT

SEQ ID NO: 9214 - protein, 776 aa, Homo sapiens; identical to SEQ ID NO: 9213

SEQ ID NO: 9215 - protein, 1429 aa, Homo sapiens
MTNPWEEKVCKMAQTSLLQGKQFYCREWVFHKLQHCLQEKSNCCNSAVNAPSLVMNSGNNASGVSGKGAAWGVLLVGGPGSGKTALCTELLWPSSPASLQRGLHRQALAFHFCKAQDSDTLCVGGFIRGLVAQICRSGLLQGYEDKLRDPAVQSLLQPGECERNPAEAFKRCVLLPLLGMKPPQQSLYLLVDSVDEGCNITEGEQTSTSLSGTVAALLAGHHEFFPPWLLLLCSARKQSKAVTKMFTGFRKISLDDLRKAYIVKDVQQYILHRLDQEEALRQHLTKETAEMLNQLHIKSSGCFLYLERVLDGVVENFIMLREIRDIPGTLNGLYLWLCQRLFVRKQFAKVQPILNVILAACRPLTITELYHAVWTKNMSLTLEDFQRKLDILSKLLVDGLGNTKILFHYSFAEWLLDVKHCTQKYLCNAAEGHRMLAMSYTCQAKNLTPLEAQEFALHLINSNLQLETAELALWMIWNGTPVRDSLSTLIPKEQEVLQLLVKAGAHVNSEDDRTSCIVRQALEREDSIRTLLDNGASVNQCDSNGRTLLANAAYSGSLDVVNLLVSRGADLEIEDAHGHTPLTLAARQGHTKVVNCLIGCGANINHTDQDGWTALRSAAWGGHTEVVSALLYAGVKVDCADADSRTALRAAAWGGHEDIVLNLLQHGAEVNKADNEGRTALIAAAYMGHREIVEHLLDHGAEVNHEDVDGRTALSVAALCVPASKGHASVVSLLIDRGAEVDHCDKDGMTPLLVAAYEGHVDVVDLLLEGGADVDHTDNNGRTPLLAAASMGHASVVNTLLFWGAAVDSIDSEGRTVLSIASAQGNVEVVRTLLDRGLDENHRDDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFLENGANVEASDAEGRTALHVSCWQGHMEMVQVLIAYHADVNAADNEKRSALQSAAWQGHVKVVQLLIEHGAVVDHTCNQGATALCIAAQEGHIDVVQVLLEHGADPNHADQFGRTAMRVAAKNGHSQIIKLLEKYGASSLNGCSPSPVHTMEQKPLQSLSSKVQSLTIKSNSSGSTGGGDMQPSLRGLPNGPTHAFSSPSESPDSTVDRQKSSLSNNSLKSSKNSSLRTTSSTATAQTVPIDSFHNLSFTEQIQQHSLPRSRSRQSIVSPSSTTQSLGQSHNSPSSEFEWSQVKPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 9216 - protein, 1250 aa, Homo sapiens
MKPPQQSLYLLVDSVDEGCNITEGEQTSTSLSGTVAALLAGHHEFFPPWLLLLCSARKQSKAVTKMFTGFRKISLDDLRKAYIVKDVQQYILHRLDQEEALRQHLTKETAEMLNQLHIKSSGCFLYLERVLDGVVENFIMLREIRDIPGTLNGLYLWLCQRLFVRKQFAKVQPILNVILAACRPLTITELYHAVWTKNMSLTLEDFQRKLDILSKLLVDGLGNTKILFHYSFAEWLLDVKHCTQKYLCNAAEGHRMLAMSYTCQAKNLTPLEAQEFALHLINSNLQLETAELALWMIWNGTPVRDSLSTLIPKEQEVLQLLVKAGAHVNSEDDRTSCIVRQALEREDSIRTLLDNGASVNQCDSNGRTLLANAAYSGSLDVVNLLVSRGADLEIEDAHGHTPLTLAARQGHTKVVNCLIGCGANINHTDQDGWTALRSAAWGGHTEVVSALLYAGVKVDCADADSRTALRAAAWGGHEDIVLNLLQHGAEVNKADNEGRTALIAAAYMGHREIVEHLLDHGAEVNHEDVDGRTALSVAALCVPASKGHASVVSLLIDRGAEVDHCDKDGMTPLLVAAYEGHVDVVDLLLEGGADVDHTDNNGRTPLLAAASMGHASVVNTLLFWGAAVDSIDSEGRTVLSIASAQGNVEVVRTLLDRGLDENHRDDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFLENGANVEASDAEGRTALHVSCWQGHMEMVQVLIAYHADVNAADNEKRSALQSAAWQGHVKVVQLLIEHGAVVDHTCNQGATALCIAAQEGHIDVVQVLLEHGADPNHADQFGRTAMRVAAKNGHSQIIKLLEKYGASSLNGCSPSPVHTMEQKPLQSLSSKVQSLTIKSNSSGSTGGGDMQPSLRGLPNGPTHAFSSPSESPDSTVDRQKSSLSNNSLKSSKNSSLRTTSSTATAQTVPIDSFHNLSFTEQIQQHSLPRSRSRQSIVSPSSTTQSLGQSHNSPSSEFEWSQVKPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 9217 - protein, 1076 aa, Homo sapiens
MGILSITDQPPLVQAIFSRDVEEVRSLLSQKENINVLDQERRTPLHAAAYVGDVPILQLLLMSGANVNAKDTLWLTPLHRAAASRNEKVLGLLLAHSADVNARDKLWQTPLHVAAANRATKCAEALAPLLSSLNVADRSGRSALHHAVHSGHLETVNLLLNKGASLNVCDKKERQPLHWAAFLGHLEVLKLLVARGADLGCKDRKGYGLLHTAAASGQIEVVKYLLRMGAEIDEPNAFGNTALHIACYLGQDAVAIELVNAGANVNQPNDKGFTPLHVAAVSTNGALCLELLVNNGADVNYQSKEGKSPLHMAAIHGRFTRSQILIQNGSEIDCADKFGNTPLHVAARYGHELLISTLMTNGADTARRGIHDMFPLHLAVLFGFSDCCRKLLSSGQLYSIVSSLSNEHVLSAGFDINTPDNLGRTCLHAAASGGNVECLNLLLSSGADLRRRDKFGRTPLHYAAANGSYQCAVTLVTAGAGVNEADCKGCSPLHYAAASDTYRRAEPHTPSSHDAEEDEPLKESRRKEAFFCLEFLLDNGADPSLRDRQGYTAVHYAAAYGNRQNLELLLEMSFNCLEDVESTIPVSPLHLAAYNGHCEALKTLAETLVNLDVRDHKGRTALFLATERGSTECVEVLTAHGASALIKERKRKWTPLHAAAASGHTDSLHLLIDSGERADITDVMDAYGQTPLMLAIMNGHVDCVHLLLEKGSTADAADLRGRTALHRGAVTGCEDCLAALLDHDAFVLCRDFKGRTPIHLASACGHTAVLRTLLQAALSTDPLDAGVDYSGYSPMHWASYTGHEDCLELLLEHSPFSYLEGNPFTPLHCAVINNQDSTTEMLLGALGAKIVNSRDAKGRTPLHAAAFADNVSGLRMLLQHQAEVNATDHTGRTALMTAAENGQTAAVEFLLYRGKADLTVLDENKNTALHLACSKGHEKCALMILAETQDLGLINATNSALQMPLHIAARNGLASVVQALLSHGATVLAVDEEGHTPALACAPNKDVADCLALILSTMKPFPPKDAVSPFSFSLLKNCSIAAAKTVGGCGALPHGASCPYSQERPGAIGLDGCYSE

SEQ ID NO: 9218 - protein, 1076 aa, Homo sapiens; identical to SEQ ID NO: 9217

SEQ ID NO: 9219 - protein, 343 aa, Homo sapiens
MASAGSTARRAGSGSWHSERGEGRGARPQPTPSGSMQQANKVSLKATWTDAESKQPSQPLPDLADHLSAQATALARPRRPASLTPPRADPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAQTCNGSTPLHLAARDGLLDCVKVLVQSGANVHAQDAMGYKPIDFCKIWNHRACARFLKDAMWKKDKKDFAREMTKMKMFKSQLTLMEHNYLIEYQGQGCSVHFPFAFSPITPETLLWQDISLLSDCGFLWRRRELSF

SEQ ID NO: 9220 - protein, 530 aa, Homo sapiens
MASAGSTARRAGSGSWHSERGEGRGARPQPTPSGSMQQANKVSLKATWTDAESKQPSQPLPDLADHLSAQATALARPRRPASLTPPRADPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAQTCNGSTPLHLAARDGLLDCVKVLVQSGANVHAQDAMGYKPIDFCKIWNHRACARFLKDAMWKKDKKDFAREMTKMKMFKSQLTLMEHNYLIEYQKEHKILREAAIRKWLHGKLHPGHSLVSNTKQARATALSKTPEQRESQRSRSFHPSVDARLQCIPQPTEMPKPIYRKPTVKRPTMWNVSNNPARPPTTQISHSQGIRLGVHPDPTPEHDFSSFLEVRPDGHGGARLHTVDGHWVAPVPRLPFEVLLRMLYPRVWPYRMKVPQGFYPISMREVPRKRHLGDNTFWTDTLAMNLRDTFDEAFLAAVRSHQGLPTLPSPQTNP

SEQ ID NO: 9221 - protein, 614 aa, Homo sapiens
MMRQATMDFSTPSVFDQQRGDSSEEVDLTMVYQAASNGDVNALTAVIREDPSILECCDSEGCTPLMHAVSGRQADTVKLLLKMGANINMQDAYGRTSLCLATYLGWLEGCVSLLRNGAKHNIPDKNGRLPLHAATAEPDMRLLTVLLQQSNISEINHQDNEGMTPLHWAAFHNQPQHTQMLLKKGADPTLVDKDFKTALHWAVQSGNRILCSIILSHHQGPSIINYDDESGKTCVHIAAAAGFSDIIHELARVPECNLQALDVDDRTPLHWAAAAGKAECVQSLLELGMDSNLRDINESTPLAYALYCGHTACVKLLSQESRTEPTRPPPSQSSRPQKKERRFNVLNQIFCKNKKEEQRAHQKDPSRDRYREEDTSEVNDIITTFDSIVGTNCQEQPGDQVAMVEFKKKTSDNSKYLLPEKKPLARKGLPPIRTQSLPPITLGNNFLTASHRATSHAGLSSAPHHMAQRSQKSRSEQDLLNNRTGCQMLLDNPWKSDSNQVFSYKVWTVSSSDKLLDRLLSVRPGHQEVSVPPHLRHLHNPSSGQNFQHLSPNRHKIRDLPFTRNNLAPLPDQKFLSGEPLRTNRVLPAIPSQRRHSTAAEESEHSANPTSDEN

SEQ ID NO: 9222 - protein, 326 aa, Homo sapiens
MDSNLRDINESTPLAYALYCGHTACVKLLSQESRTEPTRPPPSQSSRPQKKERRFNVLNQIFCKNKKEEQRAHQKDPSRDRYREEDTSEVNDIITTFDSIVGTNCQEQPGDQVAMVEFKKKTSDNSKYLLPEKKPLARKGLPPIRTQSLPPITLGNNFLTASHRATSHAGLSSAPHHMAQRSQKSRSEQDLLNNRTGCQMLLDNPWKSDSNQVFSYKVWTVSSSDKLLDRLLSVRPGHQEVSVPPHLRHLHNPSSGQNFQHLSPNRHKIRDLPFTRNNLAPLPDQKFLSGEPLRTNRVLPAIPSQRRHSTAAEESEHSANPTSDEN

SEQ ID NO: 9223 - protein, 614 aa, Homo sapiens; identical to SEQ ID NO: 9221

SEQ ID NO: 9224 - protein, 793 aa, Homo sapiens
MARELSQEALLDFLCQAGGRVTNAALLSHFKSFLRDPDASPSQHQHRRELFKGFVNSVAAVRQDPDGTKYVVLKRRYRDLLGEEGLQRPREPPAAAPSAGGAAPCSPRGARRGEPPQQQPRRRRREKEPEEEPAGAAARAADAACNGLPGSDSRRAPGKGGGSKGSPGQRPPVPAAAAAGAQARASCAAAKTQGRCCWECLQNNLAVLPGELGALPHSATAEEKPARALPAQDDRGASREREEGALAEPAPVPAVAHSPPATVEAATSRASPPALLPGPAPRGDRPELLTPSSLHYSTLQQQQQRTREWVARHPQVPEARDQGPIRAWSVLPDNFLQLPLEPGSTEPNSEPPDPCLSSHSLFPVVPDESWESWAGNPSLTVFRSIRCQLSLQDLDDFVDQESDGSEESSSGPKDSPGASEEGLQVVLGTPDRGKLRNPAGGLSVSRKEGSPSRSPQGLRNRGDGHISQQVPAGANGLAGHPLKPLPWPVPKLRRSLRRSSLAGRAKLSSSDEEYLDEGLLKRSRRPPRSRKPSKAGTAPSPRVDAGLSLKLAEVKAVVAERGWRHSLWVPSGEGSAALAPHRTSEHKSSLVPLDAREHEWIVKLASGSWIQVWTLFWEDPQLALHKDFLTGYTALHWIAKHGDLRALQDLVSGAKKAGIVLDVNVRSSCGYTPLHLAAIHGHQGVIKLLVQRLASRVNVRDSSGKKPWQYLTSNTSGEIWQLLGAPRGKPIFPVYPLVGSSSPTRKAKSKEISRSVTRKTSFAALLKSQHNKWKLANQYEKFHSPREREEYSD

SEQ ID NO: 9225 - protein, 525 aa, Homo sapiens
MEGPAEWGPEAALGPEAVLRFLAERGGRALHAELVQHFRGALGGEPEQRARARAHFKELVNAVATVRVDPADGAKYVHLKKRFCEGPSEPSGDPPRIQVTAEPEAPDGPAGPEARDRLPDAAAPESLPGQGRELGEGEPPAPAHWPPLSAGARRKNSRRDVQPLPRTPAPGPSEDLELPPHGCEEADRGSSLVGATAQRPARQNLRDLVMGSSPQLKRSVCPGGSSPGSSSGGGRGRGGGDSDSASVASSSAEEESSGGGSVTLDPLEHAWMLSASDGKWDSLEGLLTCEPGLLVKRDFITGFTCLHWAAKHGRQELLAMLVNFANKHQLPVNIDARTSGGYTALHLAAMHGHVEVVKLLVGAYDADVDIRDYSGKKASQYLSRSIAEEIKNLVGALDEGDGESAAGSGGGRWRLSKVLPSHLITYKLSHALEDGGDHHHHHHSAEGWVGGKAKDPGRKASGSSSGRIKPRLNKIRFRTQIVHTTPSFRDPEQPLEGRGEEGVGEERPVKGHSPFTLRPKSNVFG

SEQ ID NO: 9226 - protein, 315 aa, Homo sapiens
MAQLGGAANRAPTASLAPTSQSLRCAPQPRPSRADTGSLGRYWGKAAAAASREHPFPGTLMHSAAGSGRRRGALRELLGLQRAAPAGWLSEERAEELGGPSGPGSSRLCLEPREHAWILAAAEGRYEVLRELLEAEPELLLRGDPITGYSVLHWLAKHGRHEELILVHDFALRRGLRLDVSAPGSGGLTPLHLAALQGHDMVIKVLVGALGADATRRDHSGHRACHYLRPDAPWRLRELSGAEEWEMESGSGCTNLNNNSSGTTAWRAASAVGATAVETSRRVAASRTKAKDTAGSRVAQMHSLFRHLFPSFQDR

SEQ ID NO: 9227 - protein, 341 aa, Homo sapiens
  MOD_RES (1)..(1): Any amino acid
XAWGMRRAAAGAGGARAAGPTGGASRLHPNAGRRSGARAGAQGCGGPRVGSADSRALPAQPLACARGRSQRLVCDPKAASALPDLAPDVFVLRVRLEETGEMFRVANCRGDMTVRELKEELDLMVGIPFNLQRLQYLDEGVLMDDTTLKFHDVVPGGIISLCIWHHDGWTELVLAAVEGDPSKLSCLGLTEDSFYRTANSEHFEGEKWKHWTSQRAFVALYVASHRGHFDAVQYLLEHGASCLSRSPLGRTPLHVAAAMGRSDCIILLLQHGASIHDRDAKGETPISIAHRLNHTLSERQMVLLHRIAKSGIRDLNDLVMKNALQRVKSGFRSEKMTMTPH

SEQ ID NO: 9228 - protein, 345 aa, Homo sapiens
MTRGRAWGMRRAAAGAGGARAAGPTGGASRLHPNAGRRSGARAGAQGCGGPRVGSADSRALPAQPLACARGRSQRLVCDPKAASALPDLAPDVFVLRVRLEETGEMFRVANCRGDMTVRELKEELDLMVGIPFNLQRLQYLDEGVLMDDTTLKFHDVVPGGIISLCIWHHDGWTELVLAAVEGDPSKLSCLGLTEDSFYRTANSEHFEGEKWKHWTSQRAFVALYVASHRGHFDAVQYLLEHGASCLSRSPLGRTPLHVAAAMGRSDCIILLLQHGASIHDRDAKGETPISIAHRLNHTLSERQMVLLHRIAKSGIRDLNDLVMKNALQRVKSGFRSEKMTMTPH

SEQ ID NO: 9229 - protein, 903 aa, Homo sapiens
MATWRKNRDKDGFSNPGYRVRQKDLGMIHKAAIAGDVNKVMESILLRLNDLNDRDKKNRTALLLACAHGRPGVVADLVARKCQLNLTDSENRTALIKAVQCQEEVCASILLEHGANPNVRDMYGNTALHYAIDNENISMARKLLAYGADIEARSQDGHTSLLLAVNRKKEQMVAFLLKKKPDLTAIDNFGRTALILAARNGSTSVVYQLLQHNIDVFCQDISGWTAEDYAVASKFQAIRGMISEYKANKRCKSLQNSNSEQDLEMTSEGEQERLEGCESSQPQVEEKMKKCRNKKMEVSRNVHADDSDNYNDDVDELIHKIKNRKPDNHQSPGKENGEFDRLARKTSNEKSKVKSQIYFTDDLNDISGSSEKTSEDDELPYSDDENFMLLIEQSGMECKDFVSLSKSKNATAACGRSIEDQKCYCERLKVKFQKMKNNISVLQKVLSETDKTKSQSEHQNLQGKKKLCNLRFILQQQEEERIKAEELYEKDIEELKIMEEQYRTQTEVKKQSKLTLKSLEVELKTVRSNSNQNFHTHERERDLWQENHLMRDEIARLRLEIDTIKHQNQETENKYFKDIEIIKENNEDLEKTLKRNEEALTKTITRYSKELNVLMDENTMLNSELQKEKQSMSRLETEMESYRCRLAAALCDHDQRQSSKRDLQLAFQSTVNEWCHLQEDTNSHIQILSQQLSKAESTSSGLETELHYEREALKEKTLHIEHMQGVLSRTQRRLEDIEHMYQNDQPILEKYVRKQQSVEDGLFQLQSQNLLYQQQCNDARKKADNQEKTIINIQVKCEDTVEKLQAECRKLEENNKGLMKECTLLKERQCQYEKEKEEREVVRRQLQREVDDALNKQLLLEAMLEISSERRINLEDEAQSLKKKLGQMRSQVCMKLSMSTVTL

SEQ ID NO: 9230 - protein, 639 aa, Homo sapiens
MTSEGEQERLEGCESSQPQVEEKMKKCRNKKMEVSRNVHADDSDNYNDDVDELIHKIKNRKPDNHQSPGKENGEFDRLARKTSNEKSKVKSQIYFTDDLNDISGSSEKTSEDDELPYSDDENFMLLIEQSGMECKDFVSLSKSKNATAACGRSIEDQKCYCERLKVKFQKMKNNISVLQKVLSETDKTKSQSEHQNLQGKKKLCNLRFILQQQEEERIKAEELYEKDIEELKIMEEQYRTQTEVKKQSKLTLKSLEVELKTVRSNSNQNFHTHERERDLWQENHLMRDEIARLRLEIDTIKHQNQETENKYFKDIEIIKENNEDLEKTLKRNEEALTKTITRYSKELNVLMDENTMLNSELQKEKQSMSRLETEMESYRCRLAAALCDHDQRQSSKRDLQLAFQSTVNEWCHLQEDTNSHIQILSQQLSKAESTSSGLETELHYEREALKEKTLHIEHMQGVLSRTQRRLEDIEHMYQNDQPILEKYVRKQQSVEDGLFQLQSQNLLYQQQCNDARKKADNQEKTIINIQVKCEDTVEKLQAECRKLEENNKGLMKECTLLKERQCQYEKEKEEREVVRRQLQREVDDALNKQLLLEAMLEISSERRINLEDEAQSLKKKLGQMRSQVCMKLSMSTVTL

SEQ ID NO: 9231 - protein, 380 aa, Homo sapiens
MLKPKDLCPRAGTRTFLEAMQAGKVHLARFVLDALDRSIIDCRAEQGRTPLMVAVGLPDPALRARFVRLLLEQGAAVNLRDERGRTALSLACERGHLDAVQLLVQFSGDPEAADSAGNSPVMWAAACGHGAVLEFLVRSFRRLGLRLDRTNRAGLTALQLAAARGHGTCVQALTGPWGRAAAAAAARGSNSDSPPGRPAPAASPEHRRPSPRRLPRPLLARFARAAGGHGGEAGSAGKNSGRHRAQGSERPELGRSMSLALGAVTEEEAARLRAGALMALPNSPQSSGTGRWRSQEVLEGAPPTLAQAPIGLSPHPEGGPGSGRLGLRRRSTAPDIPSLVGEAPGPESGPELEANALSVSVPGPNPWQAGTEAVVLRAQR

SEQ ID NO: 9232 - protein, 399 aa, Homo sapiens
MDSQRPEPREEEEEEQELRWMELDSEEALGTRTEGPSVVQGWGHLLQAVWRGPAGLVTQLLRQGASVEERDHAGRTPLHLAVLRGHAPLVRLLLQRGAPVGAVDRAGRTALHEAAWHGHSRVAELLLQRGASAAARSGTGLTPLHWAAALGHTLLAARLLEAPGPGPAAAEAEDARGWTAAHWAAAGGRLAVLELLAAGGAGLDGALLVAAAAGRGAALRFLLARGARVDARDGAGATALGLAAALGRSQDIEVLLGHGADPGIRDRHGRSALHRAAARGHLLAVQLLVTQGAEVDARDTLGLTPLHHASREGHVEVAGCLLDRGAQVDATGWLRKTPLHLAAERGHGPTVGLLLSRGASPTLRTQWAEVAQMPEGDLPQALPELGGGEKECEGIESTG

SEQ ID NO: 9233 - protein, 174 aa, Homo sapiens
MDSQRPEPREEEEEEQELRWMELDSEEALGTRTEGPSVVQGWGHLLQAVWRGPAGLVTQLLRQGASVEERTLRCCWATGQTQASGTGMAALRCTGLPPEDTCLPSSCWSPRGPRWMRGTPWASHPCITPLGKATWRLPAACWTGVPRWMLPAGSERPPYTWLQSEGMGLPWGFC

SEQ ID NO: 9234 - protein, 65 aa, Homo sapiens
MDSQRPEPREEEEEEQELRWMELDSEEALGTRTEGPSVVQGWGHLLQAVWRGPAGLVTQLLRQGH

SEQ ID NO: 9235 - protein, 317 aa, Homo sapiens
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSAGFRCCAAPGPHVALAVRYNRVGILRRILRTLRDFPAEERARVLDRRGCSRVEGGGTSLHVACELARPECLFLLLGHGASPGLRDGGGLTPLELLLRQLGRDAGATPSAAGAPASAPGEPRQRRLLLLDLLALYTPVGAAGSARQELLGDRPRWQRLLGEDKFQWLAGLAPPSLFARAMQVLVTAISPGRFPEALDELPLPPFLQPLDLTGKG

SEQ ID NO: 9236 - protein, 105 aa, Homo sapiens
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSA

SEQ ID NO: 9237 - protein, 260 aa, Homo sapiens
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSAGFRCCAAPGPHVALAVRYNRVGILRRILRTLRDFPAEERARVLDRRGCSRVEGGGTSLHVACELARPECLFLLLGHGASPGLRDGGGLTPLELLLRQLGRDAGATPSAAGAPASAPGEPRQRRLLLLDLLALYTPVGAAGSARQELLGDRPRWQR

SEQ ID NO: 9238 - protein, 317 aa, Homo sapiens; identical to SEQ ID NO: 9235

SEQ ID NO: 9239 - protein, 317 aa, Homo sapiens; identical to SEQ ID NO: 9235

SEQ ID NO: 9240 - protein, 763 aa, Homo sapiens
MEASLTRRLLFKDRHFTCSKIIGRRFACFAQRLSHRRKQSQCDLLNESTGQLPTTCSSAASNSINWNCRVKMTQQMQNLHLCQSKKHSAPSSPNAAKRLYRNLSEKLKGSHSSFDEAYFRTRTDRLSLRKTSVNFQGNEAMFEAVEQQDMDAVQILLYQYTPEELDLNTPNSEGLTPLDIAIMTNNVPIARILLRTGARESPHFVSLESRAMHLNTLVQEAQERVSELSAQVENEGFTLDNTEKEKQLKAWEWRYRLYRRMKTGFEHARAPEMPTNVCLMVTSSTSLTVSFQEPLSVNAAVVTRYKVEWSMSEDFSPLAGEIIMDNLQTLRCTITGLTMGQQYFVQVSAYNMKGWGPAQTTTPACASPSNWKDYDDREPRHKGQSEVLEGLLQQVRALHQHYSCRESTKLQTTGRKQSVSRSLKHLFHSSNKFVKTLKRGLYIAVIFYYKDNILVTNEDQVPIVEIDDSHTSSITQDFLWFTKLSCMWEDIRWLRQSIPISSSSSTVLQTRQKMLAATAQLQNLLGTHNLGRVYYEPIKDRHGNILIVTIREVEMLYSFFNGKWMQISKLQSQRKSLSTPEEPTALDILLITIQDILSYHKRSHQRLFPGLYLGYLKLCSSVDQIKVLVTQKLPNILCHVKIRENNNISREEWEWIQKLSGSESMESVDHTSDCPMQLFFYELQMAVKALLQQINIPLHQARNFRLYTQEVLEMGHNVSFLLLLPASDDVCTAPGQNNPYTPHSGFLNLPLQMFELGIVACFT

SEQ ID NO: 9241 - protein, 276 aa, Homo sapiens [sequence omitted]

SEQ ID NO: 9242 - protein, 327 aa, Homo sapiens [sequence omitted]

SEQ ID NO: 9243 - protein, 265 aa, Homo sapiens
MAWWKSWDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 9244 - protein, 141 aa, Homo sapiens
MAWWKSWIEQEGVTVKSSSHFNPDPDAETLYQAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEGQQG

SEQ ID NO: 9245 - protein, 276 aa, Homo sapiens [sequence omitted]

SEQ ID NO: 9246 - protein, 327 aa, Homo sapiens
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGENIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 9247 - protein, 141 aa, Homo sapiens
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEGQQG

SEQ ID NO: 9248 - protein, 265 aa, Homo sapiens
MAWWKAWDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGENIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 9249 - protein, 101 aa, Homo sapiens
  MOD_RES (1)..(1): Any amino acid
XHVHLGFIIAFENVVFFFLCPNDRLVPDVPALATKITARALPGQAGGGRQPGDAVSVSKLRIWAVSQGRSGSWMRGLEFPGDLQTCTATLPCSCLLASVQC

SEQ ID NO: 9250 - protein, 258 aa, Homo sapiens [sequence omitted]

SEQ ID NO: 9251 - protein, 195 aa, Homo sapiens
MGAAVFFGCTFVAFGPAFALFLITVAGDPLRVIILVAGRCSALPTTSCLISGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCRRQEDSRVMVYSALRIPPED

SEQ ID NO: 9252 - protein, 164 aa, Homo sapiens
MEEEAETEEQQRFSYQQRLKAAVHYTVGCLCEEVALDKEMQFSKQTIAAISELTFRQCENFAKDLEMFARHAKRTTINTEDVKLLARRSNSLHMQEAAGIRKSSLLTFLAWWFEWTSQASAGPLIGEEAREVARRQEGAPPQQSARRDRMPCRNFFWKTFSSCK

SEQ ID NO: 9253 - protein, 77 aa, Homo sapiens
MEEEAETEEQQRFSYQQRLKAAVHYTVGCLCEEVALDKEMQFSKQTIAAISELTFRQCENFAKDLEMFASICRKRQE

SEQ ID NO: 9254 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 9255 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 9256 - protein, 386 aa, Homo sapiens; identical to SEQ ID NO: 9255

SEQ ID NO: 9257 - protein, 202 aa, Homo sapiens
MNPQIRNPMERMYRDTFYDNFENEPILYGRSYTWLCYEVKIKRGRSNLLWDTGVFRGPVLPKRQSNHRQEVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 9258 - protein, 1069 aa, Homo sapiens
MDFLRLYLPGLHQALRGALDSLGTFVSYLLGDAVPTVEREAQAAEELGVVAVGKTGKIVEEEAQEDLEGLRGSQNEGAGRLRGPGDDRRHEVGSSAVEQTWGWGDGSSHGSQAERQDSGAGETAKAARCQEPSAHLEARKKSKAGSGACQDRSGQAQERQESHEQEVNREERLRSWEQEEEEEEVRAREPGMARGAESEWTWHGETEGKAGAVGPKAAGDNREMEQGVREADAGETEEPGAEGAGKGEEVVVVEKACESTRAWGTWGPGAEPEDWGILGREEARTTPGREEARAILDGEEARTISGGEEAETASGGEEAETASGGEEAGTASGGEEAGIASGGEAGTASGGEEAGTASGGDEAWTTSGKEEADLLGVRQTEYGAVPGERLLEATGKVWVLEEEGDEEREAEVSPFPKQPQVLGTERTEEAAESQTAGREAVGGQEAGESFEGQVDLRGKEAEMRQDLGIRADRARMEELVQAEEAQEERGSSRDPVAELPSDGEAEGTADLEATPEARPEEELTGEESEAAQTSCGLLGVEWGGLTHSVTKGQGPELMGGAQTPTKQPEEREAGEVELMGVLALSKEEQERSLEAGPRHAGSVKPEASEAFPGAWENRTRKDMERGNTQEDAADGEQREEEETAGGQTLAAEAEGDRESELSEVPEAGGEGLTTQDAGCGTEEGEASVSENQELDGSTGADAGPCPSLGEAYARETEDEEAEADRTSRRGWRLQAVAVGLPDREDAQTGSVAAGIMGGDVVPHISAAGAGEALEGVLGQGWDSKEKEEAAAGEHAGGQEFGLEGSAEEEVTGRGSQVEAFESREGGPWGGRVEAEESAGAEDSCGLDPAGSQTARAEGMGAMVEAGGLLEKWTLLEEEAVGWQEREQREDSEGRCGDYHPEGEAPRLLDAEGLMVTGGRRAEAKETEPESLEHVRGQEEQPTHQAPAEAAPESVGEAETAEAMGSARGGAANSWSEAPLPGSLLDVSVPRSRVHLSRSSSQRRSRPSFRRTPAWEQQEEPPAPNPPEEELSAPEQRPLQLEEPLEPRWEDRLRPGVRDQPGQHSKIPIF

SEQ ID NO: 9259 - protein, 1088 aa, Homo sapiens
MDFLRLYLPGLHQALRGALDSLGTFVSYLLGDAVPTVEREAQAAEELGVVAVGKTGKIVEEEAQEDLEGLRGSQNEGAGRLRGPGDDRRHEVGSSAVEQTWGWGDGSSHGSQAERQDSGAGETAKAARCQEPSAHLEARKKSKAGSGACQDRSGQAQERQESHEQEVNREERLRSWEQEEEEEEVRAREPGMARGAESEWTWHGETEGKAGAVGPKAAGDNREMEQGVREADAGETEEPGAEGAGKGEEVVVVEKACESTRAWGTWGPGAEPEDWGILGREEARTTPGREEARAILDGEEARTISGGEEAETASGGEEAETASGGEEAGTASGGEEAGIASGGEAGTASGGEEAGTASGGDEAWTTSGKEEADLLGVRQTEYGAVPGERLLEATGKVWVLEEEGDEEREAEVSPFPKQPQVLGTERTEEAAESQTAGREAVGGQEAGESFEGQVDLRGKEAEMRQDLGIRADRARMEELVQAEEAQEERGSSRDPVAELPSDGEAEGTADLEATPEARPEEELTGEESEAAQTSCGLLGVEWGGLTHSVTKGQGPELMGGAQTPTKQPEEREAGEVELMGVLALSKEEQERSLEAGPRHAGSVKPEASEAFPGAWENRTRKDMERGNTQEDAADGEQREEEETAGGQTLAAEAEGDRESELSEVPEAGGEGLTTQDAGCGTEEGEASVSENQELDGSTGADAGPCPSLGEAYARETEDEEAEADRTSRRGWRLQAVAVGLPDREDAQTGSVAAGIMGGDVVPHISAAGAGEALEGVLGQGWDSKEKEEAAAGEHAGGQEFGLEGSAEEEVTGRGSQVEAFESREGGPWGGRVEAEESAGAEDSCGLDPAGSQTARAEGMGAMVEAGGLLEKWTLLEEEAVGWQEREQREDSEGRCGDYHPEGEAPRLLDAEGLMVTGGRRAEAKETEPESLEHVRGQEEQPTHQAPAEAAPESVGEAETAEAMGSARGGAANSWSEAPLPGSLLDVSVPRSRVHLSRSSSQRRSRPSFRRTPAWEQQEEPPAPNPPEEELSAPEQRPLQLEEPLEPSPLRHDGTPVPARRRPLGHGFGLAHPGMMQELQARLGRPKPQ

SEQ ID NO: 9260 - protein, 1097 aa, Homo sapiens
MDFLRLYLPGLHQALRGALDSLGTFVSYLLGDAVPTVEREAQAAEELGVVAVGKTGKIVEEEAQEDLEGLRGSQNEGAGRLRGPGDDRRHEVGSSAVEQTWGWGDGSSHGSQAERQDSGAGETAKAARCQEPSAHLEARKKSKAGSGACQDRSGQAQERQESHEQEVNREERLRSWEQEEEEEEVRAREPGMARGAESEWTWHGETEGKAGAVGPKAAGDNREMEQGVREADAGETEEPGAEGAGKGEEVVVVEKACESTRAWGTWGPGAEPEDWGILGREEARTTPGREEARAILDGEEARTISGGEEAETASGGEEAETASGGEEAGTASGGEEAGIASGGEAGTASGGEEAGTASGGEEAGTASGGDEAWTTSGKEEADLLGVRQTEYGAVPGERLLEATGKVWVLEEEGDEEREAEVSPFPKQPQVLGTERTEEAAESQTAGREAVGGQEAGESFEGQVDLRGKEAEMRQDLGIRADRARMEELVQAEEAQEERGSSRDPVAELPSDGEAEGTADLEATPEARPEEELTGEESEAAQTSCGLLGVEWGGLTHSVTKGQGPELMGGAQTPTKQPEEREAGEVELMGVLALSKEEQERSLEAGPRHAGSVKPEASEAFPGAWENRTRKDMERGNTQEDAADGEQREEEETAGGQTLAAEAEGDRESELSEVPEAGGEGLTTQDAGCGTEEGEASVSENQELDGSTGADAGPCPSLGEAYARETEDEEAEADRTSRRGWRLQAVAVGLPDREDAQTGSVAAGIMGGDVVPHISAAGAGEALEGVLGQGWDSKEKEEAAAGEHAGGQEFGLEGSAEEEVTGRGSQVEAFESREGGPWGGRVEAEESAGAEDSCGLDPAGSQTARAEGMGAMVEAGGLLEKWTLLEEEAVGWQEREQREDSEGRCGDYHPEGEAPRLLDAEGLMVTGGRRAEAKETEPESLEHVRGQEEQPTHQAPAEAAPESVGEAETAEAMGSARGGAANSWSEAPLPGSLLDVSVPRSRVHLSRSSSQRRSRPSFRRTPAWEQQEEPPAPNPPEEELSAPEQRPLQLEEPLEPSPLRHDGTPVPARRRPLGHGFGLAHPGMMQELQARLGRPKPQ

SEQ ID NO: 9261 - protein, 127 aa, Homo sapiens
MSLLRNRLQALPALCLCVLVLACIGACQPEAQEGTLSPPPKLKMSRWSLVRGRMKELLETVVNRTRDGWQWFWSPSTFRGFMQTYYDDHLRDLGPLTKAWFLESKDSLLKKTHSLCPRLVCGDKDQG

SEQ ID NO: 9262 - protein, 307 aa, Homo sapiens
MAGLNVSLSFFFATFTLCEAARRASKALLPVGAYEVFAREAVGAVQLGACFLEMRTLVELGPWAGDFGPDLLLTLLFLLFLAHGVTLDGASANPTVSLQEFLMAEESLPGTLLKLAAQGLGMQAACTLTRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 9263 - protein, 498 aa, Homo sapiens
MLQCRPAQEFSFGPRALKDALVSTDAALQQLYVSAFSPAERLFLAEAYNPQRTLFCTLLIRTGFDWLLSRPEAPEDFQTFHASLQHRKPRLARKHIYLQPIDLSEEPVGSSLLHQLCSCTEAFFLGLRVKCLPSVAAASIRCSSRPSRDSDRLQLHTDGILSFLKNNKPGDALCVLGLTLSDLYPHEAWSFTFSKFLPGHEVGVCSFARFSGEFPKSGPSAPDLALVEAAADGPEAPLQDRGWALCFSALGMVQCCKVTCHELCHLLGLGNCRWLRCLMQGALSLDEALRRPLDLCPICLRKLQHVLGFRLIERYQRLYTWTQAVVGTWPSQEAGEPSVWEDTPPASADSGMCCESDSEPGTSVSEPLTPDAGSHTFASGPEEGLSYLAASEAPLPPGGPAEAIKEHERWLAMCIQALQREVAEEDLVQVDRAVDALDRWEMFTGQLPATRQDPPSSRDSVGLRKVLGDKFSSLRRKLSARKLARAESAPRPWDGEES

SEQ ID NO: 9264 - protein, 302 aa, Homo sapiens
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 9265 - protein, 360 aa, Homo sapiens
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 9266 - protein, 360 aa, Homo sapiens; identical to SEQ ID NO: 9265

SEQ ID NO: 9267 - protein, 360 aa, Homo sapiens; identical to SEQ ID NO: 9265

SEQ ID NO: 9268 - protein, 360 aa, Homo sapiens; identical to SEQ ID NO: 9265

SEQ ID NO: 9269 - protein, 360 aa, Homo sapiens; identical to SEQ ID NO: 9265

SEQ ID NO: 9270 - protein, 834 aa, Homo sapiens
MTVEFEECVKDSPRFRATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEEGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 9271 - protein, 759 aa, Homo sapiens
MVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRKGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 9272 - protein, 155 aa, Homo sapiens
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWPDTFPRRLCQL

SEQ ID NO: 9273 - protein, 481 aa, Homo sapiens
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWYVPPDQVKGPTYTKGSASTPVQGSIPEGKPLRTLLGDPAPSLSVAASTSSQPVSQSHARTSQARSTQPPPHSSVKKASTDLLADIGGDPFAAPQMAPAFAAFPAFGGQTPSQGGFANFDAFSSGPSSSVFGSLPPAGQASFQAQPTPAGSSQGTPFGATPLAPASQPNSLADVGSFLGPGVPAAGVPSSLFGMAGQVPPLQSVTMGGGGGSSTGLAFGAFTNPFTAPAAQSPLPSTNPFQPNGLAPGPGFGMSSAGPGFPQAVPPTGAFASSFPAPLFPPQTPLVQQQNGSSFGDLGSAKLGQRPLSQPAGISTNPFMTGPSSSPFASKPPTTNPFL

SEQ ID NO: 9274 - protein, 663 aa, Homo sapiens
ELLRISPDLLAAAVISAQEEPLTNIQRASGPTGLLWSVSLEFDQQQGSVCPSESEIYEAGAEDRMAGAPMAAAVQPAEVTVEVGEDLHMHQVRDREMPEALEFNLSANPEASTIFQRNSQTDALEFNSSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPVCKLSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETCGEGDGCTALHLACRKGNVVLEQLLTGWTSWPEMPTGTQR

SEQ ID NO: 9275 - protein, 703 aa, Homo sapiens
MFEDVFSDSGNTGNFDRGKKRRLTIIECGCDINMMIDLAKVADLVLMLIDASFGFEMEMFEFLNICQAHGFPKILGVLTHLDSFKHNKQLKKTKKRLKHRFWTEVYQDKVGLTHELVQSLISTYSTIDAKMASSRVTLLSNSKPLGSEAIDNQGVSLEFDQQQGSVCPSESEIYEAGAEDRMAGAPMAAAVQPAEVTVEVGEDLHMHQVRDREMPEVVEIRRSNCTNHCDLGDTSSYHTKVSTVHIMKKRNGGGSLNNYSSSIPPTPSTSQEDPQFSVPPTANTPTPVCKLSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKSQLTSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETCGEGDGCTALHLACRKGNVVLEQLLTGWTSWPEMPTGTQR

SEQ ID NO: 9276 - protein, 658 aa, Homo sapiens
MGNILTCRVHPSVSLEFDQQQGSVCPSESEIYEAGAEDRMAGAPMAAAVQPAEVTVEVGEDLHMHQVRDREMPEALEFNLSANPEASTIFQRNSQTDALEFNSSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPVCKLSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKSQLTSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETCGEGDGCTALHLACRKGNVVLEQLLTGWTSWPEMPTGTQR

SEQ ID NO: 9277 - protein, 439 aa, Homo sapiens
MRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISTSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDKCV

SEQ ID NO: 9278 - protein, 663 aa, Homo sapiens
MGNILTCRVHPSVSLEFDQQQGSVCPSESEIYEAGAGDRMAGAPMAAAVQPAEVTVEVGEDLHMHHVRDREMPEALEFNPSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISTSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDKCV

SEQ ID NO: 9279 - protein, 686 aa, Homo sapiens
MGNILTCCVHPSVSLEFDQQQGSVCPSESEIYEAGAGDRMAGAPMAAAVQPAEVTVEVGEDLHMHHIRDQEMPEALEFSLSANPEASTIFQRNSQTDALEFNPSANPEASTIFQRNSQTDVVEIRRSNCTNHVSTERFSQQYSSCSTIFLDDSTASQHYLTMTIISVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSHPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDYETQNPKWASLNLGVLMCIECSGIHRSLGTRLSRVRSLELDDWPVELRKVMSSIGNDLANSIWEGSSQGQTKPSVKSTREEKERWIRSKYEEKLFLAPLPCTELSLGQHLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 9280 - protein, 663 aa, Homo sapiens
MGNILTCCVHPSVSLEFDQQQGSVCPSESEIYEAGAGDRMAGAPMAAAVQPAEVTVEVGEDLHMHHIRDQEMPEALEFNPSANPEASTIFQRNSQTDVVEIRRSNCTNHVSTERFSQQYSSCSTIFLDDSTASQHYLTMTIISVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSHPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDYETQNPKWASLNLGVLMCIECSGIHRSLGTRLSRVRSLELDDWPVELRKVMSSIGNDLANSIWEGSSQGQTKPSVKSTREEKERWIRSKYEEKLFLAPLPCTELSLGQHLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 9281 - protein, 686 aa, Homo sapiens
MGNILTCRVHPSVSLEFDQQQGSVCPSESETYEAGARDRMAGAPMAAAVQPAEVTVEVGEDLHMHHVRDREMPEALEFNLSANPESSTIFQRNSQTEALEFNPSANPEASTIFQRNSQTDVVEIRRSNCTNHVSAVRFSQQYSLCSTIFLDDSTAIQHYLTMTIISVTLEIPHHITQRDADRTLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLIWYGVDVMARDAHGNTALTYARQASSQECINVLLQYGCPDECV

SEQ ID NO: 9282 - protein, 663 aa, Homo sapiens
MGNILTCRVHPSVSLEFDQQQGSVCPSESETYEAGARDRMAGAPMAAAVQPAEVTVEVGEDLHMHHVRDREMPEALEFNPSANPEASTIFQRNSQTDVVEIRRSNCTNHVSAVRFSQQYSLCSTIFLDDSTAIQHYLTMTIISVTLEIPHHITQRDADRTLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLIWYGVDVMARDAHGNTALTYARQASSQECINVLLQYGCPDECV

SEQ ID NO: 9283 - protein, 663 aa, Homo sapiens
MGNILTCRVHPSVSLEFDQQQGSVCPSESEIYEAGAEDRMAGAPMAAAVQPAEVTVEVGEDLHMHHVRDREMPEALEFNPSANPEASTIFQRNSQTDVVEIRRSNCTNHVSTVHFSQQYSLCSTIFLDDSTAIQHYLTMTIISVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKYIHKKEIDLQTSTIKVPGKWPSLATLACTPISSSKSDGLSKDMDTGLGDSICFSPSISSTTIPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGTRLSRVRSLELDDWPVELRKVMSSIGNDLANSIWEGSSQGRTKPTEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 9284 - protein, 439 aa, Homo sapiens
MRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHHSLGTRLSRVRSLELDDWPVELRKVMSSIGNDLANSIWEGSSQGQTKPSEKSTREEKERWIRSKYEEKLFLAPLPCTELSLGQQLLWATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 9285 - protein, 663 aa, Homo sapiens
MGNILTCRVHPSVSLEFDQQQGSVCPSESEIYEAGAGDRMAGAPMAAAVQPAEVTVEVGEDLHMHHVRDREMPEALEFNPSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHHSLGTRLSRVRSLELDDWPVELRKVMSSIGNDLANSIWEGSSQGQTKPSEKSTREEKERWIRSKYEEKLFLAPLPCTELSLGQQLLWATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 9286 - protein, 663 aa, Homo sapiens
ELLRISPDLLAAAVISAQEEPLTNIQRASGPTGLLWSVSLEFDQQQGSVCPSESEIYEAGAEDRMAGAPMAAAVQPAEVTVEVGEDLHMHQVRDREMPEALEFNLSANPEASTIFQRNSQTDALEFNSSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETCGEGDGCTALHLACRKGNVVLEQLLTGWTSWPEMPTGTQR

SEQ ID NO: 9287 - protein, 348 aa, Homo sapiens
  MOD_RES (1)..(1): Any amino acid
XAEDRMAGAPMAAAVQPAEVTVEVGEDLHMHQVRDREMPEALEFNLSANPEASTIFQRNSQTDALEFNSSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGIS

SEQ ID NO: 9288 - protein, 703 aa, Homo sapiens
MFEDVFSDSGNTGNFDRGKKRRLTIIECGCDINMMIDLAKVADLVLMLIDASFGFEMEMFEFLNICQAHGFPKILGVLTHLDSFKHNKQLKKTKKRLKHRFWTEVYQDKVGLTHELVQSLISTYSTIDAKMASSRVTLLSNSKPLGSEAIDNQGVSLEFDQQQGSVCPSESEIYEAGAEDRMAGAPMAAAVQPAEVTVEVGEDLHMHQVRDREMPEVVEIRRSNCTNHCDLGDTSSYHTKVSTVHIMKKRNGGGSLNNYSSSIPPTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKSQLTSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETCGEGDGCTALHLACRKGNVVLEQLLTGWTSWPEMPTGTQR

SEQ ID NO: 9289 - protein, 658 aa, Homo sapiens
MGNILTCRVHPSVSLEFDQQQGSVCPSESEIYEAGAEDRMAGAPMAAAVQPAEVTVEVGEDLHMHQVRDREMPEALEFNLSANPEASTIFQRNSQTDALEFNSSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKSQLTSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETCGEGDGCTALHLACRKGNVVLEQLLTGWTSWPEMPTGTQR

SEQ ID NO: 9290 - protein, 1544 aa, Homo sapiens
MAAPQDLDIAVWLATVHLEQYADTFRRHGLATAGAARGLGHEELKQLGISATGHRKRILRLLQTGTEEGSLDPKSDSAMEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEGEEPWFPPAPDGSCPGLLPSDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 9291 - protein, 473 aa, Homo sapiens
MAAPQDLDIAVWLATVHLEQYADTFRRHGLATAGAARGLGHEELKQLGISATGHRKRILRLLQTGTEEGSLDPKSDSAMEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQS

SEQ ID NO: 9292 - protein, 1375 aa, Homo sapiens
MEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 9293 - protein, 1193 aa, Homo sapiens
MTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEGEEPWFPPAPDGSCPGLLPSDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 9294 - protein, 371 aa, Homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 9295 - protein, 147 aa, Homo sapiens
MGTPASVVSEPPPWQAPIEARGRKQASANIFQDAELLQIQALFQRSGDQLAEERAQIIWECAGDHRVAEALKRLRRKRPPRQKPLGHSLHHCSRLRILEPHSALANPQSATETASSEQYLHSRKKSARIRRNWRKSGPTSYLHQIRH

SEQ ID NO: 9296 - protein, 434 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 9297 - protein, 386 aa, Homo sapiens
MKEENTGAGAEAKRTNFFLKQGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 9298 - protein, 369 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGFIPNYLEIMGKIEFWKQGQNVKF

SEQ ID NO: 9299 - protein, 110 aa, Homo sapiens
GARSPGSTHQGSLASGVLPIKCSHVEFGMWKGGRSHPFLPHSSRCAGSGGQLDSILPHQSPAWGPWGCKDLSSGFPSFLTSSILWKSAVVREPHISPHQAPPYKTSDCIT

SEQ ID NO: 9300 - protein, 367 aa, Homo sapiens
MGKSIPQYLGQLDIRKSVVSLATGAGAIYLLYKAIKAGIKCKPPLCSNSPICIARECPGPGERALPQEAPAPEASAVGGPKGLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQVHSNFLNLFQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 9301 - protein, 340 aa, Homo sapiens
MGKSIPQYLGQLDIRKSVVSLATGAGAIYLLYKAIKAGIKCKPPLCSNSPICIARLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQVHSNFLNLFQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 9302 - protein, 330 aa, Homo sapiens
MGKSIPQYLGQLDIRKSVVSLATGAGAIYLLYKAIKAGIKCKPPLCSNSPICIARLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 9303 - protein, 223 aa, Homo sapiens
MLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNG

SEQ ID NO: 9304 - protein, 702 aa, Homo sapiens
MMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 9305 - protein, 867 aa, Homo sapiens
MLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 9306 - protein, 872 aa, Homo sapiens
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKYVAEKMGGKIPKEKLPDFSWELHISELKFQLKSNVIPIGHVKKGIFYHRALLFKALADRIGIGCSLVRGEYGRAWNEVMLQNDSRKGVIGGLPAPEMYVIDLMFHPGGLMKLRSREADLYRFI

SEQ ID NO: 9307 - protein, 609 aa, Homo sapiens
MDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKYVAEKMGGKIPKEKLPDFSWELHISELKFQLKSNVIPIGHVKKGIFYHRALLFKALADRIGIGCSLVRGEYGRAWNEVMLQNDSRKGVIGGLPAPEMYVIDLMFHPGGLMKLRSREADLYRFI

SEQ ID NO: 9308 - protein, 688 aa, Homo sapiens
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWSSLPTSR

SEQ ID NO: 9309 - protein, 865 aa, Homo sapiens
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNNAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKYVAEKMGGKIPKEKLPDFSWELHISELKFQLKSNVIPIGHVKKGIFYHRALLFKALADRIGIGCSLVRGEYGRAWNEVMLQNDSRKGVIGGLPAPEMYVIDLMFHPGGLMKLRSREADLYRFI

SEQ ID NO: 9310 - protein, 352 aa, Homo sapiens
MKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKQKETSQNGRNKRWIRKQNTRVIRSMIFDVGKTS

SEQ ID NO: 9311 - protein, 1044 aa, Homo sapiens
MGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 9312 - protein, 389 aa, Homo sapiens
LSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKQKETSQNGRNKRWIRKQNTRVIRSMIFDVGKTS

SEQ ID NO: 9313 - protein, 206 aa, Homo sapiens
MSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLIICLKPMKSNVRLVH

SEQ ID NO: 9314 - protein, 705 aa, Homo sapiens
MSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKKNIFIS

SEQ ID NO: 9315 - protein, 612 aa, Homo sapiens
MRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKTESRHVARLECSDNDLGSLQPPPPGFKRFSCLSLLSSWDYSFYWIWLGPLTRISRKLQLVVYPISAGWLLLQRRQDTLEI

SEQ ID NO: 9316 - protein, 935 aa, Homo sapiens
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 9317 - protein, 1030 aa, Homo sapiens
MVTLGAGVRLFTGVYPVVLNQIRATSEASAITRTTMPAPELTSTSRAEDTRDTGVQLRKRKIPQARHSRKRQRTFSFRSLGSAARSGAESEARAKMAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 9318 - protein, 579 aa, Homo sapiens
MKTDSIQNRTARALGNLAMEPESCGDIHCAGAVPLLVESLTACQDSQCLQSVALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 9319 - protein, 725 aa, Homo sapiens
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGEFPYPPVSLPPCESPSSPMASMGPEPHLPTHLSSPARPPDNLSPEWGGEQGVPVPPWAHRQSSAVSSALALGPRYPNSRCSPAPRIWAGLCFFPGSAIGSALS

SEQ ID NO: 9320 - protein, 967 aa, Homo sapiens
MHRPHVPGCAAIKFRSLGSAARSGAESEARAKMAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 9321 - protein, 476 aa, Homo sapiens
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 9322 - protein, 464 aa, Homo sapiens
MTSCRCSVTSRSLWPALAPRRCQHTSPASAQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHRPSRSPSWTWGLRHSSCRPDLPTVTVRTWPRPPCGTWVVMSSSESCGQARGATWRHDPRPSLVTLGESCDSGMGVDPCPPLSPISSVPFTMRSVFWQALGKGSGEGGAL

SEQ ID NO: 9323 - protein, 476 aa, Homo sapiens; identical to SEQ ID NO: 9321

SEQ ID NO: 9324 - protein, 501 aa, Homo sapiens
MSERCCSRYSSGASIGCTPTSTQAKMVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 9325 - protein, 501 aa, Homo sapiens; identical to SEQ ID NO: 9324

SEQ ID NO: 9326 - protein, 70 aa, Homo sapiens
MVSKRIAQETFDAAVRENIEEFAMGPEEAVKEAVEQFESQGVDLSNIVKTAPKVSADGSQEPTHDILQML

SEQ ID NO: 9327 - protein, 257 aa, Homo sapiens
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEA

SEQ ID NO: 9328 - protein, 103 aa, Homo sapiens
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACR

SEQ ID NO: 9329 - protein, 81 aa, Homo sapiens
  MOD_RES (1)..(1): Any amino acid
XKAHPQKAGVQKQACMLIRNLVAHGQAFSKPILDLGAEALIMQARSAHRDCEDVAKAALRDLGCHVELRELWTGQRGNLAP

SEQ ID NO: 9330 - protein, 30 aa, Homo sapiens
MVSKRIAQETFDAAVRENIEEFAMGPEEAV

SEQ ID NO: 9331 - protein, 161 aa, Homo sapiens
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLT

SEQ ID NO: 9332 - protein, 163 aa, Homo sapiens
MSERCCSRYSSGASIGCTPTSTQAKMVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALS

SEQ ID NO: 9333 - protein, 259 aa, Homo sapiens
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATK

SEQ ID NO: 9334 - protein, 198 aa, Homo sapiens
MAQKPKVDPHVGRLGYLQALVTEFQETQSQDAKEQVLANLANFAYDPSNYEYLRQLQVLDLFLDSLSEENETLVEFAIGGLCNLCPDRANKEHILHAGGVPLIINCLSSPNEETVLSAITTLMHLSPPGRSFLPELTATPVVQCMLRFSLSASARLRNLAQIFLEDFCSPRQVAEARSRQAHSALGIPLPRSVAPRQR

SEQ ID NO: 9335 - protein, 385 aa, Homo sapiens
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKVSLGEGRPPVLTASRQGVTST

SEQ ID NO: 9336 - protein, 663 aa, Homo sapiens [sequence omitted]

SEQ ID NO: 9337 - protein, 198 aa, Homo sapiens
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLT

SEQ ID NO: 9338 - protein, 130 aa, Homo sapiens
MKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFS

SEQ ID NO: 9339 - protein, 26 aa, Homo sapiens
MEVTASSRHYVDRLFDPDPQKVLQGV

SEQ ID NO: 9340 - protein, 673 aa, Homo sapiens
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 9341 - protein, 385 aa, Homo sapiens; identical to SEQ ID NO: 9335

SEQ ID NO: 9342 - protein, 659 aa, Homo sapiens
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 9343 - protein, 631 aa, Homo sapiens
MKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 9344 - protein, 642 aa, Homo sapiens
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 9345 - protein, 530 aa, Homo sapiens
YQDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 9346 - protein, 665 aa, Homo sapiens
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKELFQDSWTPELKLKLIKFLALISKASNTPKLLTIYKENGQSNKEILQQLHQQLVEAERRSVTYLKRYNKIQADYHNLIGVTAELVDSLEATVSGKMITPEYLQSVCVRLFSNQMRQSLAHSVDFTRPGTASTMLRASLAPVKLKDVPLLPSLDYEKLKKDLILGSDRLKAFLLQALRWRLTTSHPGEQRETVLQAYISNDLLDCYSHNQRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRSTGKNMCAKVAGLVLKVLSDLLGHENHEIQPYVNGALYSILSVPSIREEARAMGMEDILRCFIKEGNAEMIRQIEFIIKQLNSEELPDGVLESDDDEDEDDEEDHDIMEADLDKDELIQPQLGELSGEKLLTTEYLGIMTNTGKTRRKGLANVQWSGDEPLQRPVTPGGHRNGYPV

SEQ ID NO: 9347 - protein, 816 aa, Homo sapiens
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKELFQDSWTPELKLKLIKFLALISKASNTPKLLTIYKENGQSNKEILQQLHQQLVEAERRSVTYLKRYNKIQADYHNLIGVTAELVDSLEATVSGKMITPEYLQSVCVRLFSNQMRQSLAHSVDFTRPGTASTMLRASLAPVKLKDVPLLPSLDYEKLKKDLILGSDRLKAFLLQALRWRLTTSHPGEQRETVLQAYISNDLLDCYSHNQRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRSTGKNMCAKVAGLVLKVLSDLLGHENHEIQPYVNGALYSILSVPSIREEARAMGMEDILRCFIKEGNAEMIRQIEFIIKQLNSEELPDGVLESDDDEDEDDEEDHDIMEADLDKDELIQPQLGELSGEKLLTTEYLGIMTNTGKTRRKGLANVQWSGDEPLQRPVTPGGHRNGYPVVEDQHTPPQTAQHARNGHPQALPAAHEAVYREGKPSTPESCVSSSSAIIAKPGEWLPRGRQEEPRPAPTPRQPREAPQDPGNGVTTRECASAFTCKPRAPCTPEMLDWNPPKAKASVLAPLFSSCGPQQASRPGSTASSTRGLPSKETHPK

SEQ ID NO: 9348 - protein, 166 aa, Homo sapiens
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKEL

SEQ ID NO: 9349 - protein, 379 aa, Homo sapiens
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAGNEETKLQVLKLLLNLAENPAMTRELLRAQVPSSLGSLFNKKENKEVILKLLVIFENINDNFKWEENEPTQNQFGEGSLFFFLKEFQVCADKVLGIESHHDFLVKVKVGKFMAKLAEHMFPKSQE

SEQ ID NO: 9350 - protein, 379 aa, Homo sapiens; identical to SEQ ID NO: 9349

SEQ ID NO: 9351 - protein, 2290 aa, Homo sapiens
MGRIQEVGWVTAGLVIWAGTCYYIYKFTKGRAQSVRTLARNGSTVKMETVVGVQSQTLAINEAEIKTKPQVEIGAETGARSGPRAEVETKATAIAIHRANSQAKAMVGAEPETQSESKVVAGTLVMTEAVTLTEVKAKAREVAMKEAVTQTDAEAGKIVKKEAVTQTKAKAWALVAKTEAKREAMTQTKAETHILAEKETEINRVMVTQSETLAVPREVAKMGATNKTGIVDETKTRALEETVSVAKTQSEARPGATVDARGNPNGMSREVAGVDMKSCAQSQAVTKIQGDDMPGTGVEDMGNCKTMSRAESGADTRASAQPQIFAKTQTEAIPGAKIDAGGNTNAMCKVGAGADVRACIQPQTVAKKQAEVTSGARVDGRGNTNVISKAITGADMRAAAQPQAVASTHAEAMSDAKVKNRGNPNAMTKAGAKANLRANSQVEALPDARDKSRGNPNVMAKVGDGTDMLSCTQPQLVASVQADTLSDGKIKVRGNVNTMPKEGAGVDMKAQGMAQSQGEALPNTRGKARGKAKAKCKTGPGMDMKTCTQPQAGVKTPAEALLDSRVDGRGNPNATSKAGTKADQRVCGQPLVVANPQGEALPGAKNKVKGNPHTVLKVGAGEGTTDSAQPEAVVSFQGEALLGTKNKVKGNPNVVLKAEVGEGAMGTAQLQIMASSKGEALLDSKNKVKGNSNAVSKAGAGTDTTGSVQPQIVANSQGEVLPGAKNKIRGNPTTVPNSGVGPYTTDSARLQAVANSQGEVLPGAKNKVKANLNAVSKAEAGMGATGSVQPQAVANSHCETLPGAKNKVRGNWNAVSKAGAGMDTRGSAQPQAVANSQGEVLPGAKNKVKGNPNVVSKAGAREDTVGSTQPQVLASSQRETLPGARNKVKGNSNVVSKAGAREDTMGSAQPQVVANSQRETLPGARNKVKGNSNAISKAEAGAGIMGSVQVQVVASFQGEVLPGAKNKVRGNSNAVPKAEAGADTVGSAQPQAVANSQSETLLGARNKVKGNTIAVPKAGTGAGTRHSAQPQIVAGSQGETLPGARDKSMSTSEAEATAEDEAYAKPEAEAMPTSESEGGSGTQACRKTQPNIHDYYWNGIGVEDWIAAERWIKFRFQTMDGDWENSVSWADDENEASIGSWSGASDKAGIIRSWAVACDETSVKSWAGARAENVVGIGTWARAGEQASGGLWAGGQTSEGTWAGDKASGGAWTGAENQASGGSWALAGNQAIGELWAAGQASDGSWPGGQASGVSWVGEEAIGGSWTGAENQASEGSWAGAGAGNMSSVSYWAGVVDQAGGGSWAGTSDQSGGGSKPRFEDQASGEGSWAGAGGQASGGSMLGPEDQSSGRSWADTADQASGGSRLGHVDQSSGGAWAGTLDQSGGGSKPRFENQTTEEGSWAGAGGQAGGGSKVGPEDQSSGRSWANSGDQISGGFLVGIVDQANGGSWTGAGHPASVGPKPIFEDQVSGRGSWADAREQVVGDSRLGLRDQSSGDSWADTGDQASGWFCVCPGSQTNGGSWGGASGQDVGGSRPGPTNQSSAGSWDSPGSQVSGSCWTGAGAVDQAGGCSKPGFEDQAIGGGFWPGAGDQTGGGSRPGSEDQSSGIGSWGVAGGQVLGGARPGPADQSSGGSWAGTGNQSSGRSWIGPGDQAVDCSKPEFEDQACGGGSWAGAGSQASGESWAGSRPGNEAIGGSRMGSEDQATGGSWARSEDQASGRFQVSFEVEANEGFWFGPGAEAVIGSWCWTEEKADIVSRPDDKDEATTASRSGAGEEAMICSRIEAENKASSGSWIRSEEVAYMGSCVGAEAGAGAEAGAGAEAGAGAGAEAGAEAGAGAGAGPGTESGAGIWSWDGDATTVESRLGAGEEAGVESWTLARNVGEDELSRESSPDIEEISLRSLFWAESENSNTFRSKSGKDASFESGAGDNTSIKDKFEAAGGVDIGSWFCAGNENTSEDKSAPKAKAKKSSESRGIYPYMVPGAGMGSWDGAMIWSETKFAHQSEASFPVEDESRKQTRTGEKTRPWSCRCKHEANMDPRDLEKLICMIEMTEDPSVHEIANNALYNSADYSYSHEVVRNVGGISVIESLLNNPYPSVRQKALNALNNISVAAENHRKVKTYLNQVCEDTVTYPLNSNVQLAGLRLIRHLTITSEYQHMVTNYISEFLRLLTVGSGETKDHVLGMLLNFSKNPSMTKDLLIANAPTSLINIFSKKETKENILNALSLFENINYHFKRRAKAFTQDKFSKNSLYFLFQRPKACAKKLRALAAECNDPEVKERVELLISKL

SEQ ID NO: 9352 - protein, 300 aa, Homo sapiens
MGRAREVGWMAAGLMIGAGACYCVYKLTIGRDDSEKLEEEGEEEWDDDQELDEEEPDIWFDFETMARPWTEDGDWTEPGAPGGTEDRPSGGGKANRAHPIKQRPFPYEHKNTWSAQNCKNGSCVLDLSKCLFIQGKLLFAEPKDAGFPFSQDINSHLASLSMARNTSPTPDPTVREALCAPDNLNASIESQGQIKMYINEVCRETVSRCCNSFLQQAGLNLLISMTVINNMLAKSASDLKFPLISEGSGCAKVQVLKPLMGLSEKPVLAGELVGAQMLFSFMSLFIRNGNREILLETPAP

SEQ ID NO: 9353 - protein, 300 aa, Homo sapiens; identical to SEQ ID NO: 9352

SEQ ID NO: 9354 - protein, 300 aa, Homo sapiens; identical to SEQ ID NO: 9352

SEQ ID NO: 9355 - protein, 558 aa, Homo sapiens
MVDSGTEARARGKAEAGLQDGISGPATARVNGKTQAEAVAEAELKTESVTQAKAGDGAMTRTHTVTYREAMAVTREVIKVEDTTKTRVMVETKTKPLAERSIVPQTKSKAMPMSRVSTVTKSEVKVVAVIEANIRSYAKSHDKANTGSRPDRREETSIGMKSSDEDEENICSWFWTGEEPSVGSWFWPEEETSLQVYKPLPKIQEKPKPTHKPTLTIKQKVIAWSRARYIVLVPVEGGEQSLPPEGNWTLVETLIETPLGIRPLTKIPPYHGPYYQTLAEIKKQIRQREKYGPNPKACHCKSRGFSLEPKEFDKLVALLKLTKDPFIHEIATMIMGISPAYPFTQDIIHDVGITVMIENLVNNPNVKEHPGALSMVDDSSESSEEPKSGESYIHQVCKGIISCPLNSPVQLAGLKLLGHLSIKFEDHYVITSYIPDFLTLLNKGSVKTKFYVLKVFSCLSKNHANTRELISAKVLSSLVAPFNKNESKANILNIIEIFENINFQFKTKAKLFTKEKFTKSELISIFQEAKQFGQKLQDLAEHSDPEVRDKVIRLILKL

SEQ ID NO: 9356 - protein, 558 aa, Homo sapiens; identical to SEQ ID NO: 9355

SEQ ID NO: 9357 - protein, 558 aa, Homo sapiens; identical to SEQ ID NO: 9355

SEQ ID NO: 9358 - protein, 558 aa, Homo sapiens; identical to SEQ ID NO: 9355

SEQ ID NO: 9359 - protein, 558 aa, Homo sapiens; identical to SEQ ID NO: 9355

SEQ ID NO: 9360 - protein, 210 aa, Homo sapiens
MFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPQKWIKQYTGINAINQKKFVIDVGYERFLGPEIFFHPEFANPDSMESISDVVDEVIQNCPIDVRRPLYKMEQIPLSYPQGHGFHPLSPPFH

SEQ ID NO: 9361 - protein, 51 aa, Homo sapiens
MFESFNVPGLYIAVQAVLALAASWTSRQVGERTLTGIVIDSGDGVTHVIPV

SEQ ID NO: 9362 - protein, 210 aa, Homo sapiens; identical to SEQ ID NO: 9360

SEQ ID NO: 9363 - protein, 625 aa, Homo sapiens
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 9364 - protein, 407 aa, Homo sapiens
MLFDKVKAFSVQLDGATAGVEPVFSGGQAVAGRVLLELSSAARVGALRLRARGRAHVHWTESRSAGSSTAYTQSYSERVEVVSHRATLLAPDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVCVDIPGTSKLLLELPLVIGTIPLHPFGSRSSSVGSHASFLLDWRLGALPERPEAPPEYSEVVADTEEAALGQSPFPLPQDPDMSLEGPFFAYIQEFRYRPPPLYSEEDPNPLLGDMRPRCMTC

SEQ ID NO: 9365 - protein, 402 aa, Homo sapiens
MRSGGVRSFALELARGPGGAYRGGERLCGRVLLEAAAPLRVRALEVKARGGAATHWLEGRSVGVNAVSSDYAAAETYLRRRQLLLRDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVCVDIPGTSKLLLELPLVIGTIPLHPFGSRSSSVGSHASFLLDWRLGALPERPEAPPEYSEVVADTEEAALGQSPFPLPQDPDMSLEGPFFAYIQEFRYRPPPLYSEEDPNPLLGDMRPRCMTC

SEQ ID NO: 9366 - protein, 418 aa, Homo sapiens
MGGEAGCAAAVGAEGRVKSLGLVFEDERKGCYSSGETVAGHVLLEASEPVALRALRLEAQGRATAAWGPSTCPRASASTAALAVFSEVEYLNVRLSLREPPAGEGIILLQPGKHEFPFRFQLPSEPLVTSFTGKYGSIQYCVRAVLERPKVPDQSVKRELQVVSHVDVNTPALLTPVLKTQEKMVGCWFFTSGPVSLSAKIERKGYCNGEAIPIYAEIENCSSRLIVPKAAIFQTQTYLASGKTKTIRHMVANVRGNHIASGSTDTWNGKTLKIPPVTPSILDCCIIRVDYSLAVYIHIPGAKKLMLELPLVIGTIPYNGFGSRNSSIASQFSMDMSWLTLTLPEQPEAPPNYADVVSEEEFSRHIPPYPQPPNCEGEVCCPVFACIQEFRFQPPPLYSEVDPHPSDVEESQPVSFIL

SEQ ID NO: 9367 - protein, 331 aa, Homo sapiens
MQGEADARTGCAEWQGEGIILLQPGKHEFPFRFQLPSEPLVTSFTGKYGSIQYCVRAVLERPKVPDQSVKRELQVVSHVDVNTPALLTPVLKTQEKMVGCWFFTSGPVSLSAKIERKGYCNGEAIPIYAEIENCSSRLIVPKAAIFQTQTYLASGKTKTIRHMVANVRGNHIASGSTDTWNGKTLKIPPVTPSILDCCIIRVDYSLAVYIHIPGAKKLMLELPLVIGTIPYNGFGSRNSSIASQFSMDMSWLTLTLPEQPEAPPNYADVVSEEEFSRHIPPYPQPPNCEGEVCCPVFACIQEFRFQPPPLYSEVDPHPSDVEESQPVSFIL

SEQ ID NO: 9368 - protein, 342 aa, Homo sapiens
MGDREECLSTPQPPMSVVKSIELVLPEDRIYLAGSSIKGQVILTLNSTLVDPIVKVELVGRGYVEWSEEAGASCDYSRNVICNNKADYVHKTKTFPVEDNWLSAGSHTFDFHFNLPPRLPSTFTSKFGHVFYFVQASCMGREHILAKKRMYLLVQGTSTFHKETPFQNPLFVEAEEKVSYNCCRQGTVCLQIQMERNTFTPGEKVVFTTEINNQTSKCIKTVVFALYAHIQYEGFTPSAERRSRLDSSELLRQEANTPVTRFNTTKVVSTFNLPLLLSVSSSTQDGEIMHTRYELVTTVHLPWSLTSLKAKVPIIITSASVDSAICQLSEDGVLPVNPDHQN

SEQ ID NO: 9369 - protein, 280 aa, Homo sapiens
METHHGICSRLCKESDSVVLAVGYRKLPKHKFPVPVRDCLVATIHFLKSLDAYGVDPARVVVCGDSFGGAIAAVVCQQLVDRPDLPRIRAQILIYAILQALDLQTPSFQQRKNIPLLTWSFICYCFFQNLDFSSSWQEVIMKGAHLPAEVWEKYRKWLGPENIPERFKERGYQLKPHEPMNEAAYLEVSVVLDVMCSPLIAEDDIVSQLPETCIVSCEYDALRDNSLLYKKRLEDLGVPVTWHHMEDGFHGVLRTIDMSFLHFPCSMRILSALVQFVKGL

SEQ ID NO: 9370 - protein, 350 aa, Homo sapiens
MIFEKLRICSMPQFFCFMQDLPPLKYDPDVVVTDFRFGTIPVKLYQSKASTCTLKPGIVYYHGGGGVMGSLKTHHGICSRLCKESDSVVLAVGYRKLPKHKFPVPVRDCLVATIHFLKSLDAYGVDPARVVVCGDSFGGAIAAVVCQQLVDRPDLPRIRAQILIYAILQALDLQTPSFQQRKNIPLLTWSFICYCFFQNLDFSSSWQEVIMKGAHLPAEVWEKYRKWLGPENIPERFKERGYQLKPHEPMNEAAYLEVSVVLDVMCSPLIAEDDIVSQLPETCIVSCEYDALRDNSLLYKKRLEDLGVPVTWHHMEDGFHGVLRTIDMSFLHFPCSMRILSALVQFVKGL

SEQ ID NO: 9371 - protein, 525 aa, Homo sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 9372 - protein, 643 aa, Homo sapiens
MCGICCSVNFSAEHFSQDLKEDLLYNLKQRGPNSSKQLLKSDVNYQCLFSAHVLHLRGVLTTQPVEDERGNVFLWNGEIFSGIKVEAEENDTQILFNYLSSCKNESEILSLFSEVQGPWSFIYYQASSHYLWFGRDFFGRRSLLWHFSNLGKSFCLSSVGTQTSGLANQWQEVPASGLFRIDLKSTVISGCIILQLYPWKYISRENIIEENVNSLSQISADLPAFVSVVANEAKLYLEKPVVPLNMMLPQAALETHCSNISNVPPTREILQVFLTDVHMKEVIQQFIDVLSVAVKKRVLCLPRDENLTANEVLKTCDRKANVAILFSGGIDSMVIATLADRHIPLDEPIDLLNVAFIAEEKTMPTTFNREGNKQKNKCEIPSEEFSKDVAAAAADSPNKHVSVPDRITGRAGLKELQAVSPSRIWNFVEINVSMEELQKLRRTRICHLIRPLDTVLDDSIGCAVWFASRGIGWLVAQEGVKSYQSNAKVVLTGIGADEQLAGYSRHRVRFQSHGLEGLNKEIMMELGRISSRNLGRDDRVIGDHGKEARFPFLDENVVSFLNSLPIWEKANLTLPRGIGEKLLLRLAAVELGLTASALLPKRAMQFGSRIAKMEKINEKASDKCGRLQIMSLENLSIEKETKL

SEQ ID NO: 9373 - protein, 618 aa, Homo sapiens
MCGICCSVNFSAEHFSQDLKEDLLYNLKQRGPNSSKQLLKSDVNYQCLFSAHVLHLRGVLTTQPVEDERGNVFLWNGEIFSGIKVEAEENDTQILFNYLSSCKNESEILSLFSEVQGPWSFIYYQASSHYLWFGRDFFGRRSLLWHFSNLGKSFCLSSVGTQTSGLANQWQEVPASGLFRIDLKSTVISGCIILQLYPWKYISRENIIEENVNSLSQISADLPAFVSVVANEAKLYLEKPVVPLNMMLPQAALETHCSNISNVPPTREILQVFLTDVHMKEVIQQFIDVLSVAVKKRVLCLPRDENLTANEVLKTCDRKANVAILFSGGIDSMVIATLADRHIPLDEPIDLLNVAFIAEEKTMPTTFNREGNKQKNKCEIPSEEFSKDVAAAAADSPNKHVSVPDRITGRAGLKELQAVSPSRIWNFVEINVSMEELQKLRRTRICHLIRPLDTVLDDSIGCAVWFASRGIGWLVAQEGVKSYQSNAKVVLTGIGADEQLAGYSRHRVRFQSHGLEGLNKEIMMELGRISSRNLGRDDRVIGDHGKEARFPFLDENVVSFLNSLPIWEKANLTLPRGIGEKLLLRLAAVELGLTASALLPKRAMQFGSRIAKMEKINE

SEQ ID NO: 9374 - protein, 73 aa, Homo sapiens
MCGICCSVNFSAEHFSQDLKEDLLYNLKQRGPNSSKQLLKSDVNYQCLFSAHVLHLRGVLTTQPVEDERGNVF

SEQ ID NO: 9375 - protein, 187 aa, Homo sapiens
MERSAFMELDAGSRLVMHLREWPALLVSSTGWTEFEQLTLDGHNLPSLVCVITGSVDLGVCLHMSSSGLDLPMKVVDMFGCCLPVCAVNFKCLHELVKHEENGLVFEDSEELAALQMLFSNFPDPAGKLNQFWKNLRESQQLRWDESWVQTVLPLVMDIQLLGQRLKPRDPCCPSRSFFSESQGKPF

SEQ ID NO: 9376 - protein, 178 aa, Homo sapiens
MGDRVKGSKSRRPDLVVEVAHPKIIHESGAQILRHANLLSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWQSLLACCQLPSRPGIHLC

SEQ ID NO: 9377 - protein, 283 aa, Homo sapiens
MADRGPWRVGVVGYGRLGQSLVSRLLAQGPELGLELVFVWNRDPGRMAGSVPPSLQLQNLAALGERRPDLVVEVAHPKIIHESGAQILRHANLLVGSPSALSDQTTERQLLEASQHWDHAVFVARGALWGAEDIRRLDAAGGLRSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWQSLLACCQLPSRPGIHLC

SEQ ID NO: 9378 - protein, 485 aa, Homo sapiens [sequence omitted]

SEQ ID NO: 9379 - protein, 441 aa, Homo sapiens
MSGHSPTRGAMQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPVVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKSRSPCRISWSGMTPPVEPPLDLSWLLGWGCGCWI

SEQ ID NO: 9380 - protein, 378 aa, Homo sapiens
LSLSLSLSLFLDVSLSLSVSLSFSLSHPGSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPVVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 9381 - protein, 431 aa, Homo sapiens
MEGVGGLWPWVLGLLSLPGVILGAPLASSCAGACGTSFPDGLTPEGTQASGDKDIPAINQGLILEETPESSFLIEGDIIRPSPFRLLSATSNKWPMGGSGVVEVPFLLSSKYDEPSRQVILEALAEFERSTCIRFVTYQDQRDFISIIPMYGCFSSVGRSGGMQVVSLAPTCLQKGRGIVLHELMHVLGFWHEHTRADRDRYIRVNWNEILPGFEINFIKSQSSNMLTPYDYSSVMHYGRLAFSRRGLPTITPLWAPSVHIGQRWNLSASDITRVLKLYGCSPSGPRPRGRGSHAHSTGRSPAPASLSLQRLLEALSAESRSPDPSGSSAGGQPVPAGPGESPHGWESPALKKLSAEASARQPQTLASSPRSRPGAGAPGVAQEQSWLAGVSTKPTVPSSEAGIQPVPVQGSPALPGGCVPRNHFKGMSED

SEQ ID NO: 9382 - protein, 679 aa, Homo sapiens
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQVKLQDFFQCGTYVCPDALNLGLPEWVLVALAKGQLSPFISDALVLRRTILPTQVENMQQPNAHRISQPIRQIIYGLLLNASPHLDKTSWNALPPQPLAFSEVERINKNIRTSIIDAVELAKDHSDLSRLTELSLRRRQMLLLETLKVKQTILEPIPTSLKLPIAVSCYWLQHTETKAKLHHLQSLLLTMLVGPLIAIINSPGKEELQEDGAKMLYAEFQRVKAQTRLGTRLDLDTAHIFCQWQSCLQMGMYLNQLLSTPLPEPDLTRLYSGSLVHGLCQQLLASTSVESLLSICPEAKQLYEYLFNATRSYAPAEIFLPKGRSNSKKKRQKKQNTSCSKNRGRTTAHTKCWYEGNNRFGLLMVENLEEHSEASNIE

SEQ ID NO: 9383 - protein, 397 aa, Homo sapiens
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQVKLQDFFQCGTYVCPDALNLGLPEWVLVALAKGQLSPFISDALVLRRTILPTQVENMQPLAFSEVERINKNIRTSILTAHNASGALDCHNQQPW

SEQ ID NO: 9384 - protein, 48 aa, Homo sapiens
MGIRGLMSFVEDHSNEFFTDLKLRDTKIVIDGYALFHRLCFSSNLDLR

SEQ ID NO: 9385 - protein, 50 aa, Homo sapiens
MGIRGLMSFVEDHSNEFFTDLKLRDTKIVIDGYALFHRLCFSSNLDLRYG

SEQ ID NO: 9386 - protein, 7 aa, Homo sapiens
MGIRGLM

SEQ ID NO: 9387 - protein, 84 aa, Homo sapiens
MERKNDPLPISTVGTRGKGPKRDEQYRIMWNELETLVRAHINNSEKHQRVLECLMACRSKPPEEEERKKEEERGKTKRTSQRKQ

SEQ ID NO: 9388 - protein, 706 aa, Homo sapiens
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKELSPVLTSEVHSVRAGRHLATKLNILVQQHFDLASTTITNIPMKEEQHANTSANYDVELLHHKDAHVDFLKSGDSHLGGGSREGSFKETITLKWCTPRTNNIELHYCTGAYRISPVDVNSRPSSCLTNFLLNGRSVLLEQPRKSGSKVISHMLSSHGGEIFLHVLSSSRSILEDPPSISEGCGGRVTDYRITDFGEFMRENRLTPFLDPRYKIDGSLEVPLERAKDQLEKHTRYWPMIISQTTIFNMQAVVPLASVIVKESLTEEDVLNCQKTIYNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 9389 - protein, 293 aa, Homo sapiens
MVVLFYWNNHESQVLKSLVICLVAMEERFLHVLSSSRSILEDPPSISEGCGGRVTDYRITVVPLASVIVKESLTEEDVLNCQKTIYNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 9390 - protein, 163 aa, Homo sapiens
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICI

SEQ ID NO: 9391 - protein, 124 aa, Homo sapiens
MAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKE

SEQ ID NO: 9392 - protein, 605 aa, Homo sapiens
MAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKELSPVLTSEVHSVRAGRHLATKLNILVQQHFDLASTTITNIPMKEEQHANTSANYDVELLHHKDAHVDFLKSGDSHLGGGSREGSFKETITLKWCTPRTNNIELHYCTGAYRISPVDVNSRPSSCLTNFLLNGRSVLLEQPRKSGSKVISHMLSSHGGEIFLHVLSSSRSILEDPPSISEGCGGRVTDYRITDFGEFMRENRLTPFLDPRYKIDGSLEVPLERAKDQLEKHTRYWPMIISQTTIFNMQAVVPLASVIVKESLTEEDVLNCQKTIYNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 9393 - protein, 225 aa, Homo sapiens
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKE

SEQ ID NO: 9394 - protein, 1603 aa, Homo sapiens
MRVKPQGLVVTSSAVCSSPDYLREPKYYPGGPPTPRPLLPTRPPASPPDKAFSTHAFSENPRPPPRRDPSTRRPPVLAKGDDPLPPRAARPVSQARCPTPVGDGSSSRRCWDNGRVNLRPVVQLIDIMKDLTRLSQDLQHSGVHLDCGGLRLSRPPAPPPGDLQYSFFSSPSLANSIRSPEERATPHAKSERPSHPLYEPEPEPRDSPQPGQGHSPGATAAATGLPPEPEPDSTDYSELADADILSELASLTCPEAQLLEAQALEPPSPEPEPQLLDPQPRFLDPQALEPLGEALELPPLQPLADPLGLPGLALQALDTLPDSLESQLLDPQALDPLPKLLDVPGRRLEPQQPLGHCPLAEPLRLDLCSPHGPPGPEGHPKYALRRTDRPKILCRRRKAGRGRKADAGPEGRLLPLPMPTGLVAALAEPPPPPPPPPPALPGPGPVSVPELKPESSQTPVVSTRKGKCRGVRRMVVKMAKIPVSLGRRNKTTYKVSSLSSSLSVEGKELGLRVSAEPTPLLKMKNNGRNVVVVFPPGEMPIILKRKRGRPPKNLLLGPGKPKEPAVVAAEAATVAAATMAMPEVKKRRRRKQKLASPQPSYAADANDSKAEYSDVLAKLAFLNRQSQCAGRCSPPRCWTPSEPESVHQAPDTQSISHFLHRVQGFRRRGGKAGGFGGRGGGHAAKSARCSFSDFFEGIGKKKKVVAVAAAGVGGPGLTELGHPRKRGRGEVDAVTGKPKRKRRSRKNGTLFPEQVPSGPGFGEAGAEWAGDKGGGWAPHHGHPGGQAGRNCGFQGTEARAFASTGLESGASGRGSYYSTGAPSGQTELSQERQNLFTGYFRSLLDSDDSSDLLDFALSASRPESRKASGTYAGPPTSALPAQRGLATFPSRGAKASPVAVGSSGAGADPSFQPVLSARQTFPPGRAASYGLTPAASDCRAAETFPKLVPPPSAMARSPTTHPPANTYLPQYGGYGAGQSVFAPTKPFTGQDCANSKDCSFAYGSGNSLPASPSSAHSAGYAPPPTGGPCLPPSKASFFSSSEGAPFSGSAPTPLRCDSRASTVSPGGYMVPKGTTASATSAASAASSSSSSFQPSPENCRQFAGASQWPFRQGYGGLDWASEAFSQLYNPSFDCHVSEPNVILDISNYTPQKVKQQTAVSETFSESSSDSTQFNQPVGGGGFRRANSEASSSEGQSSLSSLEKLMMDWNEASSAPGYNWNQSVLFQSSSKPGRGRRKKVDLFEASHLGFPTSASAAASGYPSKRSTGPRQPRGGRGGGACSAKKERGGAAAKAKFIPKPQPVNPLFQDSPDLGLDYYSGDSSMSPLPSQSRAFGVGERDPCDFIGPYSMNPSTPSDGTFGQGFHCDSPSLGAPELDGKHFPPLAHPPTVFDAGLQKAYSPTCSPTLGFKEELRPPPTKLAACEPLKHGLQGASLGHAAAAQAHLSCRDLPLGQPHYDSPSCKGTAYWYPPGSAARSPPYEGKVGTGLLADFLGRTEAACLSAPHLASPPATPKADKEPLEMARPPGPPRGPAAAAAGYGCPLLSDLTLSPVPRDSLLPLQDTAYRYPGFMPQAHPGLGGGPKSGFLGPMAEPHPEDTFTVTSL

SEQ ID NO: 9395 - protein, 1603 aa, Homo sapiens; identical to SEQ ID NO: 9394

SEQ ID NO: 9396 - protein, 149 aa, Homo sapiens
MRVKPQGLVVTSSAVCSSPDYLREPKYYPGGPPTPRPLLPTRPPASPPDKAFSTHAFSENPRPPPRRDPSTRRPPVLAKGDDPLPPRAARPVSQARCPTPVGDGSSSRRCWDNGRVNLRPVVQLIDIMKDLTRLSQDLQHSGVHLDCGG

SEQ ID NO: 9397 - protein, 412 aa, Homo sapiens
MEALQKQQAARLAQGVGPLAPACPLLPPQPPLPDHRTLQAPEGALGNVGAEEEEDAEEDEEKREEAGAEEEAAEESRPGAQGPSSPSSQPPGLHPHEWTYEEQFKQLYELDADPKRKEFLDDLFSFMQKRGTPVNRVPIMAKQVLDLYALFRLVTAKGGLVEVINRKVWREVTRGLSLPTTITSAAFTLRTQYMKYLYPYECETRALSSPGELQAAIDSNRREGRRQAYTATPLFGLAGPPPRGAQDPALGPGPAPPATQSSPGPAQGSTSGLPAHACAQLSPSPIKKEESGIPNPCLALPVGLALGPTREKLAPEEPPEKRAVLMGPMDPPRPCMPPSFLPRGKVPLREERLDGPLNLAGSGISSINMALEINGVVYTGVLFARRQPVPASQGPTNPAPPPSTGPPSSILP

SEQ ID NO: 9398 - protein, 146 aa, Homo sapiens
MTSERSRIPCLSAAAAEGTGKKQQEGRAMATLDRKVPSPEAFLGKPWSSWIDAAKLHCSDNVDLEEAGKEGGKSREVMRLNKEDMHLFGHYPAHDDFYLVVCSACNQVVKPQVFQSHCGRKQDNRRNEGISRSGPESSQAIEKHQV

SEQ ID NO: 9399 - protein, 533 aa, Homo sapiens
MDGADESEKLDCQFSTHHPRPLAFCSFGSRLMGRGYYVFDRRWDRFRFALNSMVEKHLNSQMWKHRNPSHRASGPSPLFRTCLTNLLSLSNIGAAWVSTLESVAPRYPLNLAAQTPGPGGPEPGGMAADGGVEDIRKKRNGQDSFFFNKHLTLHQEPPTQYSLSARKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVRDLLAPPSPALGGRGSWAAPLLSRAAPTGNTSLIPVLVFPEGSFHPLL

SEQ ID NO: 9400 - protein, 861 aa, Homo sapiens
MTSERSRIPCLSAAAAEGTGKKQQEGRAMATLDRKVPSPEAFLGKPWSSWIDAAKLHCSDNVDLEEAGKEGGKSREVMRLNKEDMHLFGHYPAHDDFYLVVCSACNQVVKPQVFQSHCERRHGSMCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVGKNSSLALSQSSPSSISSPGHSRQNTNRTGRIRTLP

SEQ ID NO: 9401 - protein, 738 aa, Homo sapiens
MCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVGKNSSLALSQSSPSSISSPGHSRQKNTNRTGRIRTLP

SEQ ID NO: 9402 - protein, 349 aa, Homo sapiens
MPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACPASMPPTKDNLVPSYPAGSPSVAAACSQAECMGGSQAITSPLPANTPSPSFSKLPPSKASKSSKGKDGVEVEAPSRKRKLSPGPTTLKRTCILEPTGKGKPSGCRGLSAKTKTALSMGLNGTMGPRVKRAGPLDCRGSPHQLPTPVKASQLENRGAAGHPAKALPTNCLSEEEVAKKRKNLATYCRPVKAKHCQAGAPADVACSVRRKKPGPALAFEEKCSTLKSKAH

SEQ ID NO: 9403 - protein, 722 aa, Homo sapiens
MAVRERAAAAMAALERRVPSLDDFAGQSWSSWVERADLPAADGAELEESSKNTKKLDAMTLIKEDMSIFGHCPAHDDFYLVVCNHCSQVVKPQAFQKHCERRHGPLSKLYGRAPPPPPAPASSQKCHVVNGQGPACRAPGSTKTSSREKGQGSRSRGHQPPEKTQKDNLCQPGGLTKDSPGKPPMAPPSKEPPGRENIEIIPSEGSSHWAEGSPPEKEPSGTRLPPKTHRKMARKECDLNRQCGVINPETKKICTRLLTCKIHSVHQRREVQGRAKDFDVLVAELKANSRKGESPKEKSPGRKEQVLERPSQELPSSVQVVAAVAAPSSTFSVRAKQTYPYCALPRSRASSESELDDEGPCGGDGDPGLFPFPMPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACPASMPPTKDNLVPSYPAGSPSVAAACSQAECMGGSQAITSPLPANTPSPSFSKLPPSKASKSSKGKDGVEVEAPSRKRKLSPGPTTLKRTCILEPTGKGKPSGCRGLSAKTKTALSMGLNGTMGPRVKRAGPLDCRGSPHQLPTPVKASQLENRGAAGHPAKALPTNCLSEEEVAKKRKNLATYCRPVKAKHCQAGAPADVACSVRRKKPGPALAFEEKCSTLKSKAH

SEQ ID NO: 9404 - protein, 580 aa, Homo sapiens
MAVRERAAAAMAALERRVPSLDDFAGQSWSSWVERADLPAADGAELEESSKNTKKLDAMTLIKEDMSIFGHCPAHDDFYLVVCNHCSQVVKPQAFQKHCERRHGPLSKLYGRAPPPPPAPASSQKCHVVNGQGPACRAPGSTKTSSREKGQGSRSRGHQPPEKTQKDNLCQPGGLTKDSPGKPPMAPPSKEPPGRENIEIIPSEGSSHWAEGSPPEKEPSGTRLPPKTHRKMARKECDLNRQCGVINPETKKICTRLLTCKIHSVHQRREVQGRAKDFDVLVAELKANSRKGESPKEKSPGRKEQVLERPSQELPSSVQVVAAVAAPSSTFSVRAKQTYPYCALPRSRASSESELDDEGPCGGDGDPGLFPFPMPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACPASMPPTKDNLVPSYPAGSPSVAAACSQAECMGEPGYHLTTACQHAIPVLQQAAAFQGQQVIQRQGRGGGGGPFSKAEVIPWPYHS

SEQ ID NO: 9405 - protein, 97 aa, Homo sapiens
MEEISLANLDTNKLEAIAQEIYVDLIEDSCLGFCFEVHRAVKCGYFYLEFAETGSVKDFGIQPVEDKGACRLPLCSLPGEPGNGPDQQLQRSPPEFQ

SEQ ID NO: 9406 - protein, 514 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQARPGLALQGMATVKDAFPACPLPICCERGASLPWGLSPGSALFLRGERTLPLPRPGPTLLPSPRTEAFGPSDPIPLSQVSFCVWGEEGMISVWFDVLFLSSVSAWVSVC

SEQ ID NO: 9407 - protein, 331 aa, Homo sapiens
MAVAMVKLCERAGLPLLAAPLLRSLLPRAPQPGPAQPRSVQGQRCPARHPPGNLVCERGAGVNGVTAGAGGRLRGLHRGGRALGCSAHRPLHSARVRPPAHLAAPPGSSARGCRLTELGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 9408 - protein, 1938 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPEPDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLANCFDLTPDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRAAVDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 9409 - protein, 1940 aa, Homo sapiens
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPEPDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLANCFDLTPDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRAAVDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKVQLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 9410 - protein, 2078 aa, Homo sapiens
MPWPFSESIKKRACRYLLQRYLGHFLQEKLSLEQLSLDLYQGTGSLAQVPLDKWCLNEILESADAPLEVTEGFIQSISLSVPWGSLLQDNCALEVRGLEMVFRPRPRPATGSEPMYWSSFMTSSMQLAKECLSQKLTDEQGEGSQPFEGLEKFAETIETVLRRVKVTFIDTVLRIEHVPENSKTGTALEIRIERTVYCDETADESSGINVHQPTAFAHKLLQLSGVSLFWDEFSASAKSSPVCSTAPVETEPKLSPSWNPKIIYEPHPQLTRNLPEIAPSDPVQIGRLIGRLELSLTLKQNEVLPGAKLDVDGQIDSIHLLLSPRQVHLLLDMLAAIAGPENSSKIGLANKDRKNRPMQQEDEYRIQMELNRYYLRKDSLSVGVSSEQSFYETETARTPSSREEEVFFSMADMDMSHSLSSLPPLGDPPNMDLELSLTSTYTNTPAGSPLSATVLQPTWGEFLDHHKEQPVRGSTFPSNLVHPTPLQKTSLPSRSVSVDESRPELIFRLAVGTFSISVLHIDPLSPPETSQNLNPLTPMAVAFFTCIEKIDPARFSTEDFKSFRAVFAEACSHDHLRFIGTGIKVSYEQRQRSASRYFSTDMSIGQMEFLECLFPTDFHSVPPHYTELLTFHSKEETGSHSPVCLQLHYKHSENRGPQGNQARLSSVPHKAELQIKLNPVCCELDISIVDRLNSLLQPQKLATVEMMASHMYTSYNKHISLHKAFTEVFLDDSHSPANCRISVQVATPALNLSVRFPIPDLRSDQERGPWFKKSLQKEILYLAFTDLEFKTEFIGGSTPEQIKLELTFRELIGSFQEEKGDPSIKFFHVSSGVDGDTTSSDDFDWPRIVLKINPPAMHSILERIAAEEEEENDGHYQEEEEGGAHSLKDVCDLRRPAPSPFSSRRVMFENEQMVMPGDPVEMTEFQDKAISNSHYVLELTLPNIYVTLPNKSFYEKLYNRIFNDLLLWEPTAPSPVETFENISYGIGLSVASQLINTFNKDSFSAFKSAVHYDEESGSEEETLQYFSTVDPNYRSRRKKKLDSQNKNSQSFLSVLLNINHGLIAVFTDVKQDNGDLLENKHGEFWLEFNSGSLFCVTKYEGFDDKHYICLHSSSFSLYHKGIVNGVILPTETRLPSSTRPHWLEPTIYSSEEDGLSKTSSDGVGGDSLNMLSVAVKILSDKSESNTKEFLIAVGLKGATLQHRMLPSGLSWHEQILYFLNIADEPVLGYNPPTSFTTFHVHLWSCALDYRPLYLPIRSLLTVETFSVSSSVALDKSSSTLRIILDEAALHLSDKCNTVTINLSRDYVRVMDMGLLELTITAVKSDSDGEQTEPRFELHCSSDVVHIRTCSDSCAALMNLIQYIASYGDLQTPNKADMKPGAFQRRSKVDSSGRSSSRGPVLPEADQQMLRDLMSDAMEEIDMQQGTSSVKPQANGVLDEKSQIQEPCCSDLFLFPDESGNVSQESGPTYASFSHHFISDAMTGVPTENDDFCILFAPKAAMQEKEEEPVIKIMVDDAIVIRDNYFSLPVNKTDTSKAPLHFPIPVIRYVVKEVSLVWHLYGGKDFGIVPPTSPAKSYISPHSSPSHTPTRHGRNTVCGGKGRNHDFLMEIQLSKVKFQHEVYPPCKPDCDSSLSEHPVSRQVFIVQDLEIRDRLATSQMNKFLYLYCSKEMPRKAHSNMLTVKALHVCPESGRSPQECCLRVSLMPLRLNIDQDALFFLKDFFTSLSAEVELQMTPDPEVKKSPGADVTCSLPRHLSTSKEPNLVISFSGPKQPSQNDSANSVEVVNGMEEKNFSAEEASFRDQPVFFREFRFTSEVPIRLDYHGKHVSMDQGTLAGILIGLAQLNCSELKLKRLSYRHGLLGVDKLFSYAITEWLNDIKKNQLPGILGGVGPMHSLVQLVQGLKDLVWLPIEQYRKDGRIVRGFQRGAASFGTSTAMAALELTNRMVQTIQAAAETAYDMVSPGTLSIEPKKTKRFPHHRLAHQPVDLREGVAKAYSVVKEGITDTAQTIYETAAREHESRGVTGAVGEVLRQIPPAVVKPLIVATEATSNVLGGMRNQIRPDVRQDESQKWRHGDD

SEQ ID NO: 9411 - protein, 737 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 9412 - protein, 267 aa, Homo sapiens
MRVAALISGGKDSCYNMMQCIAAGHQIVALANLRPAENQVGSDELDSYMYQTVGHHAIDLYAEAMALPLYRRTIRGRSLDTRQVYTKCEGDEVEDLYELLKLVKEKEEVEGISVGAILSDYQRIRVENVCKRLNLQPLAYLWQRNQEDLLREMISSNIQAMIIKVAALGLDPDKHLGKTLDQMEPYLIELSKKYGVHVCGEGGEYETFTLDCPLFKKKIIVDSSEVVIHSADAFAPVAYLRFLELHLEDKVSSVPDNYRTSNYIYNF

SEQ ID NO: 9413 - protein, 165 aa, Homo sapiens
MRVAALISGGKDSCYNMMQCIAAGHQIVALANLRPAENQVGSDELDSYMYQTVGHHAIDLYAEAMALPLYRRTIRGRSLDTRQVYTKCEGDEVEDLYELLKLVKGITRMTLLAEYDALNLQDFHMHLKVGSQAIVYRTPNELCTHSKFDKHTFPPFISEIAKCEV

SEQ ID NO: 9414 - protein, 1101 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 9415 - protein, 95 aa, Homo sapiens
MAHFKDDLQTNVEIIPGESAPRKESPRPPAPPSSAAGVGGCSNHSPSVQESPLSPPALAQLGSAQQPSMRTELSFSEKKDTMIIWQITITVWCQR

SEQ ID NO: 9416 - protein, 95 aa, Homo sapiens; identical to SEQ ID NO: 9415

SEQ ID NO: 9417 - protein, 257 aa, Homo sapiens
MAAPWASLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 9418 - protein, 191 aa, Homo sapiens
MWDLVLEDRRMNSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLRTSAGWTSRTSLPCPTLASLRYWWRRCCPIARLWESTGLRA

SEQ ID NO: 9419 - protein, 263 aa, Homo sapiens
MWDLVLEDRRMNSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 9420 - protein, 230 aa, Homo sapiens
MAAPWASLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 9421 - protein, 333 aa, Homo sapiens
MELDIHSAQVPLPVGRGRHRDATPESKGSLQDLGWSAVAQSQLTATSTSPAQVIPPPQPRWSRTPGFKRCFRLGLHKVLGSQSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 9422 - protein, 230 aa, Homo sapiens; identical to SEQ ID NO: 9420

SEQ ID NO: 9423 - protein, 1220 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 9424 - protein, 1458 aa, Homo sapiens
MVNTRKSSLRLLGSKSPGPGPGPGAGAEPGATGGSSHFISSRTRSSKTRAASCPAAKAGGSGGAGVTLDEARKVEVDGSLSDSHVSPPAKRTLKQPDSVCKDKSKSRSTGQREEWNLSTGQARLTSQPGATLPNGHSGLSLRSHPLRGEKKGDGDLSCINGDMEVRKSCRSRKNRFESVNQSLLFDQLVNSTAEAVLQEMDNINIRQNRRSGEVERLRMWTDTEFENMDMYSRVKRRRKSLRRNSYGIQNHHEVSTEGEEEESQEEDGDIEVEEAEGEENDRPYNLRQRKTVDRYQAPPIVPAHQKKRENTLFDIHRSPARRSHIRRKKHAIHSSDTTSSDEERFERRKSKSMARARNRCLPMNFRAEDLASGILRERVKVGASLADVDPMNIDKSVRFDSIGGLSHHIHALKEMVVFPLLYPEIFEKFKIQPPRGCLFYGPPGTGKTLVARALANECSQGDKKVAFFMRKGADCLSKWVGESERQLRLLFDQAYLMRPSIIFFDEIDGLAPVRSSRQDQIHSSIVSTLLALMDGLDNRGEIVVIGATNRLDSIDPALRRPGRFDREFLFNLPDQKARKHILQIHTRDWNPKLSDAFLGELAEKCVGYCGADIKALCTEAALIALRRRYPQIYASSHKLQLDVSSIVLSAQDFYHAMQNIVPASQRAVMSSGHALSPIIRPLLERSFNNILAVLQKVFPHAEISQSDKKEDIETLILEDSEDENALSIFETNCHSGSPKKQSSSAAIHKPYLHFTMSPYHQPTSYRPRLLLSGERGSGQTSHLAPALLHTLERFSVHRLDLPALYSVSAKTPEESCAQIFREARRTVPSIVYMPHIGDWWEAVSETVRATFLTLLQDIPSFSPIFLLSTSETMYSELPEEVKCIFRIQYEEVLYIQRPIEEDRRKFFQELILNQASMAPPRRKHAALCAMEVLPLALPSPPRQLSESEKSRMEDQEENTLRELRLFLRDVTKRLATDKRFNIFSKPVDIEEVSDYLEVIKEPMDLSTVITKIDKHNYLTAKDFLKDIDLICSNALEYNPDKDPGDKIIRHRACTLKDTAHAIIAAELDPEFNKLCEEIKEARIKRGLSVTSEQINPHSTGARKTETRVEEAFRHKQRNPMDVWHNSANKCAFRVRRKSRRRSQWGKGIIKKRKVNNLKKDEEDTKFADYENHTEDRKLLENGEFEVSTDCHEENGEETGDLSMTNDESSCDIMDLDQGQRLNNGAGTKENFASTEEESSNESLLVNSSSSLNPEQTSRKETFLKGNCLNGEASTDSFEGIPVLECQNGKLEVVSFCDSGDKCSSEQKILLEDQSKEKPETSTENHGDDLEKLEALECSNNEKLEPGSDVEVKDAELDKEGASKVKKYRKLILEQAKTTSLELVPEEPSEPVPPLIVDRERLKKLLDLLVDKSNNLAVDQLERLYSLLSQCIYRHRKDYDKSQLVEEMERTVHMFETFL

SEQ ID NO: 9425 - protein, 212 aa, Homo sapiens
MEVRKSCRSRKNRFESVNQSLLFDQLVNSTAEAVLQEMDNINIRQNRRSGEVERLRMWTDTEFENMDMYSRVKRRRKSLRRNSYGIQNHHEVSTEGEEEARTSKLLPLEKISIESQEEDGDIEVEEAEGEENDRPYNLRQRKTVDRYQAPPIVPAHQKKRENTLFDIHRSPARRSHIRRKKHAIHSSDTTSSDEERFERRKSKSMARARNRK

SEQ ID NO: 9426 - protein, 626 aa, Homo sapiens
MPHIGDWWEAVSETVRATFLTLLQDIPSFSPIFLLSTSETMYSELPEEVKCIFRIQYEEVLYIQRPIEEDRRKFFQELILNQASMAPPRRKHAALCAMEVLPLALPSPPRQLSESEKSRMEDQEENTLRELRLFLRDVTKRLATDKRFNIFSKPVDIEEVSDYLEVIKEPMDLSTVITKIDKHNYLTAKDFLKDIDLICSNALEYNPDKDPGDKIIRHRACTLKDTAHAIIAAELDPEFNKLCEEIKEARIKRGLSVTSEQINPHSTGARKTETRVEEAFRHKQRNPMDVWHNSANKCAFRVRRKSRRRSQWGKGIIKKRKVNNLKKDEEDTKFADYENHTEDRKLLENGEFEVSTDCHEENGEETGDLSMTNDESSCDIMDLDQGQRLNNGAGTKENFASTEEESSNESLLVNSSSSLNPEQTSRKETFLKGNCLNGEASTDSFEGIPVLECQNGKLEVVSFCDSGDKCSSEQKILLEDQSKEKPETSTENHGDDLEKLEALECSNNEKLEPGSDVEVKDAELDKEGASKVKKYRKLILEQAKTTSLELVPEEPSEPVPPLIVDRERLKKLLDLLVDKSNNLAVDQLERLYSLLSQCIYRHRKDYDKSQLVEEMERTVHMFETFL

SEQ ID NO: 9427 - protein, 411 aa, Homo sapiens
MSKDALNLAQMQEQTLQLEQQSKLKQLVNEDLRKQEESVQKHHQTFLESIRAAGTLFGEGFRAFVTDRDKVTATVAGLTLLAVGVYSAKNATAVTGRYIEARLGKPSLVRETSRITVLEALRHPIQQVSRRLLSRPQDVLEGVVLSPSLEARVRDIAIMTRNIKKNRGLYRHILLYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLILASCHPEQFDWAINACIDVMVHFDLPGQEERARLVRMYLNEYVLKPATEGKRRLKLAQFDYGRKCLEIARLTEGMSCRKIAQLAVSWQATAYASKDGVLTEAMMDACVQDFVQQHQQMMRWLKGERPGPEDEQPSS

SEQ ID NO: 9428 - protein, 703 aa, Homo sapiens
MATCAEILRSEFPEIDGQVFDYVTGVLHSGSADFESVDDLVEAVGELLQEVSGDSKDDAGIRAVCQRMAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 9429 - protein, 709 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 9430 - protein, 1190 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSARFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 9431 - protein, 1190 aa, Homo sapiens; identical to SEQ ID NO: 9430

SEQ ID NO: 9432 - protein, 1259 aa, Homo sapiens
MDGPTRGHGLRKKRRSRSQRDRERRSRGGLGAGAAGGGGAGRTRALSLASSSGSDKEDNGKPPSSAPSRPRPPRRKRRESTSAEEDIIDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFCDSDSDQEEKASDASSEKLFNTVIVNKDPELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSLFHSYPPAVSGIPPMIPPTGPFGSLQGAFQPKTSNPIDVAARPGTVPHTLLQKDPRLTDPFRPMLRKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 9433 - protein, 266 aa, Homo sapiens
MDGPTRGHGLRKKRRSRSQRDRERRSRGGLGAGAAGGGGAGRTRALSLASSSGSDKEDNGKPPSSAPSRPRPPRRKRRESTSAEEDIIDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFRSGKMCLGEEACLKSGNDMKRDVSNTSSWASNRESFFSLVKLLKGF

SEQ ID NO: 9434 - protein, 1235 aa, Homo sapiens
MDGPTRGHGLRKKRRSRSQRDRERRSRGGLGAGAAGGGGAGRTRALSLASSSGSDKEDNGKPPSSAPSRPRPPRRKRRESTSAEEDIIDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFCDSDSDQEEKASDASSEKLFNTVIVNKDPELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSLFHSYPPAVSGIPPMIPPTGPFGSLQGAFQPKLTDPFRPMLRKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 9435 - protein, 140 aa, Homo sapiens
MVTAMALSKSTNSHKNATEDLYEVDKLKKECYEWINTCSCLLSNIKGRKITLLTYEEIERLLEEEAVKEFIEPEIDESFKEDEEESKEDRKLQEENKERAEEQPSTSTEKEKLIRFIGEDENVHSKPLFETDVLSSWKNI

SEQ ID NO: 9436 - protein, 896 aa, Homo sapiens
MVDRSKLLPTSLQNEFIPKEVLLSLTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHKPKTLTDTLIPEEFHIVSSTGVSGLECYDDKYTTLLTDSENRLLLFPSMKPNKRVEVAQLNDVMDTMLERAGVENQEYTGPTKMHKLLHILKKEQTIYNMIFHELIRQVSVDCADRGELLSKVRERYVQMLDQIARQMIDFYKDLVTQRVMDQRILEELYNFKHVIEELTRELCLVRAHDVKLTKETEKAHKDLAQALLNAEKNAKIVEEYHDLYTLQRERMENDMKKLVAERDIWSSATYELALKVIERNRVILARRLYLNEKGWNKYTKHFIILLSNKDTEDLALLQKLTQKWRNLVNKLKQEVEQMEESTSETLKIVKDGLIKWQEFFNEKDILSPNKGNIFNSVLLDFKQWQKILNEKKEEFTGDVLLSKYDTLKIIKHLQENWADIGLGIFNRHKSLEGEMPSERQYMEEIIKNIQKLYKEYEIRINGDNGYSKILPSLISSLDFCSFKLENLEFPDTPLEEWQEIDEKINEMKSHLDILLNLTGIVPQHIDVDSVSVLQAYIFNMIQQWLLKIGNEINNGNIELQHHMDELHISMIQWMVNLLILMIPNFTDQDCLLKLEEESAEKHDIGVARLELDAIELTRKLYQYSSYLSSCCKGMVTAMALSKSTNSHKNATEDLYEVDKLKQPSTSTEKEKLIRFIGEDENVHSKPLFETDVLSSWRESAKQGTLAQKYLEAMAVIEHMQEKLLEVENRARQAEEKFEDAYEKLHHTLIKNKDLEELVMTSRKESKEEKENQDEREVKEEEEQQEEEEVRSAENSSKSPKKGH

SEQ ID NO: 9437 - protein, 1012 aa, Homo sapiens
MSLPKTPSTPLNSTSTSESKKLKVSVAKEGTRGLPELKEKKNMVDRSKLLPTSLQNEFIPKEVLLSLTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHKPKTLTDTLIPEEFHIVSSTGVSGLECYDDKYTTLLTDSENRLLLFPSMKPNKRVEVAQLNDVMDTMLERAGVENQEYTGPTKMHKLLHILKKEQTIYNMIFHELIRQVSVDCADRGELLSKVRERYVQMLDQIARQMIDFYKDLVTQRVMDQRILEELYNFKHVIEELTRELCLVRAHDVKLTKETEKAHKDLAQALLNAEKNAKIVEEYHDLYTLQRERMENDMKKLVAERDIWSSATYELALKVIERNRVILARRLYLNEKGWNKYTKHFIILLSNKDTEDLALLQKLTQKWRNLVNKLKQEVEQMEESTSETLKIVKDGLIKWQEFFNEKDILSPNKGNIFNSVLLDFKQWQKILNEKKEEFTGDVLLSKYDTLKIIKHLQENWADIGLGIFNRHKSLEGEMPSERQYMEEIIKNIQKLYKEYEIRINGDNGYSKILPSLISSLDFCSFKLENLEFPDTPLEEWQEIDEKINEMKSHLDILLNLTGIVPQHIDVDSVSVLQAYIFNMIQQWLLKIGNEINNGNIELQHHMDELHISMIQWMVNLLILMIPNFTDQDCLLKLEEESAEKHDIGVARLELDAIELTRKLYQYSSYLSSCCKGMVTAMALSKSTNSHKNATEDLYEVDKLKKECYEWINTCSCLLSNIKGRKITLLTYEEIERLLEEEAVKEFIEPEIDESFKEDEEESKEDRKLQEENKERAEEQPSTSTEKEKLIRFIGEDENVHSKPLFETDVLSSWRESAKQGTLAQKYLEAMAVIEHMQEKLLEVENRARQAEEKFEDAYEKLHHTLIKNKDLEELVMTSRKESKEEKENQDEREVKEEEEQQEEEEVRSAENSSKSPKKGH

SEQ ID NO: 9438 - protein, 655 aa, Homo sapiens
MSLPKTPSTPLNSTSTSESKKLKVSVAKEGTRGLPELKEKKNMVDRSKLLPTSLQNEFIPKEVLLSLTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHKPKTLTDTLIPEEFHIVSSTGVSGLECYDDKYTTLLTDSENRLLLFPSMKPNKRVEVAQLNDVMDTMLERAGVENQEYTGPTKMHKLLHILKKEQTIYNMIFHELIRQVSVDCADRGELLSKVRERYVQMLDQIARQMIDFYKDLVTQRVMDQRILEELYNFKHVIEELTRELCLVRAHDVKLTKETEKAHKDLAQALLNAEKNAKIVEEYHDLYTLQRERMENDMKKLVAERDIWSSATYELALKVIERNRVILARRLYLNEKGWNKYTKHFIILLSNKDTEDLALLQKLTQKWRNLVNKLKQEVEQMEESTSETLKIVKDGLIKWQEFFNEKDILSPNKGNIFNSVLLDFKQWQKILNEKKEEFTGDVLLSKYDTLKIIKHLQENWADIGLGIFNRHKSLEGEMPSERQYMEEIIKNIQKLYKEYEIRINGDNETGSHRVAQAGLKLLGSSDHPTSAPQSAGIRGIIHRTWPWVNFYIVCEVTPKFFQV

SEQ ID NO: 9439 - protein, 78 aa, Homo sapiens
MSLPKTPSTPLNSTSTSESKKLKVSVAKEGTRGLPELKEKKNMVDRSKLLPTSLQNEFIPKEVLLSLTYAANAGPCPE

SEQ ID NO: 9440 - protein, 125 aa, Homo sapiens
MSLPKTPSTPLNSTSTSESKKLKVSVAKEGTRGLPELKEKKNMVDRSKLLPTSLQNEFIPKEVLLSLTYAANAGPCPENLLPPKKIKTPKGTLPRLVDHVWHHPVRRNKFKYLIDHPVSLTGAGR

SEQ ID NO: 9441 - protein, 39 aa, Homo sapiens
MAAGAVFLALSAQLLQARLMKEESPVVSWRLEPEDGTAL

SEQ ID NO: 9442 - protein, 48 aa, Homo sapiens
MAAGAVFLALSAQLLQARLMKEVSPVVSWRLEPEDGTALSGVSLCRPG

SEQ ID NO: 9443 - protein, 193 aa, Homo sapiens
MPLPWDYPEAPWRRLHSSPPRPCPRALQGGGRRGPNPDPRGSKGLKQTVGALNPNLHLWGICSCQFLLRSKGRDFVHSVQETHSQLLGSWDPWEEPEDAAPVAPSVPASGYPELPTPRREVQSESAQEPGARDVEAQLRRLQEERTCKVCLDRAVSIVFVPCGHLVCAECAPGLQLCPICRAPVRSRVRTFLS

SEQ ID NO: 9444 - protein, 2608 aa, Homo sapiens
MDGRDFAPPPHLLSERGSLGHRSAAAAARLAPAGPAAQPPAHFQPGKYFPSPLPMASHTGSARKMGSCPAPSFLPSFLERPLYPAPTKTVSGPSLRPPTAAIRSPTPDCAQKWSQNAHEAPGYPRFSGSLASTFLPVSHLDHHGNSNVLYGQHRFYGTQKDNFYLRNLPPQPTLLPANHNFPSVARAAPAHPMGSCSRDRDRGEAGSLQKGPKDFDRFLVGKELGREKAGKAAEGKERPAAEEDGGKERHKLVLPVPADGHCREGGPAPRGACEGRPKHLTSCLLNTKVLNGEMGRAALASCAGGMLGRPGTGVVTSGRCAKEAAGPPEPGPAFSECLERRQMLHHTASYAGPPPPLSTAAGSFPCLQLHGGPDGLCPLQDKAPRDLKASGPTFVPSVGHLADKGRPFQAAEACAVAGEGKDRHLEGTMAPDHAAPYGVSYAHLKAEGKGERRPGGFEAALNPRLKGLDYLSSAGPEASFPGLPKSGLDKSGYFELPTSSQDCARPGHQDPLGGKAPQACCTLDKTVGKEAPAGPPGAQKVARIRHQQHLMAAEVEQGGIGAEAKRKSLELASLGYSGPHLPPWGVQAGQGTAMAISEERKAGAYLDPFGSGLQQAALLPQELPAPPDEVSAMKNLLKYSSQALVVGQKAPLVGLGGLKASCIQQEAKFLSSKGPGQSERPDCARSREHDTTHGDGEVRQPPVGIAVALARQKDTVSRSEAAYGTNTARQGRAAPAFKGGGGPRSTHALDLEAEEERTRLCDDRLGLASRELLLQDSKDRVEFARIHPPSSCPGDLAPHLMMQSGQLGGDPAPHTHPHPPWLPRTRSPSLWMGGHSYGLGHPALHQNLPPGFPASVAGPVPSVFPLPQDAPTQLVILPSEPTPHSAPHALADVMDQASLWPPMYGGRGPASHMQHPGQLPVYSRPQLLRQQELYALQQQRAAQFQRKPEDQHLDLEEPAQEKAPKSTHKPVALTPTAPGAPSPAAGPTKLPPCCHPPDPKPPASSPTPPPRPSAPCTLNVCPASSPGPGSRVRSAEEKNGEGQQSTADIITSEPDLPPGYLRPMAGLGFSLPSDVHSSNLEDPETMQTTAPGAQPEPTRTFLPGEPPPCSPRSLEEPGLLSGAREATQDLAATPYPTERGPQGKAADPSPLEGLQELQCAALLEAGGPEATGQAHSTQGGAREERSREEGEQGPSSGASSQVLEQRAGSPGALEDEGEQPAPEEDELEEDELGQQSMEDSEEDCGGAPDNSHPPRALPGLDALVAATINLGDLPSDSPPDPQPPAASGPPSTVPLPHSSGIHGIALLSELADLAIQRQRSERTVPEEEEDVLAFNLQHLATLATAWSLVEAAGLDSSTAPAQPPTANPCSGPRLTPRMQILQRKDTWTPKTKPVCPLKAAIDRLDTQEVGMRVRLAELQRRYKEKQRELARLQRKHDHERDESSRSPARRGPGRPRKRKHSSSLPAPRPTGPLPRSDGKKVKAVRTSLGLLCAELRGGSGGEPAKKRSKLERSVYAGLQTASVEKAQCKKSSCQGGLAPSVAHRVAQLKPKVKSKGLPTGLSSFQQKEATPGGRIREKLSRAKSAKVSGATRHPQPKGHGSRETPRCPAQPSVAASQEAGSGYDSEDCEGLLGTEAPPREAGLLLHTGASVAVLGPSPSSVVKMEANQKAKKKKERQGLLGACRLSSPESEVKIKRRSVKAKVGTTLERAPGQRPPGALGKKKAKGKAKGSLRAEPGATPSRDALFNPSRAFACREEGSQLASERLKRATRKGTVLQPVLRRKNGALSITLATRNAKAILGKGRKLSKVKHKAGKQGKGRAVSRLLESFAVEEDFEFDDNSSFSEEEEDEEEEEEDSGPLSAEQSAALARSCAIHKEDLRDGLPVLIPKEDSLLYAGSVRTLQPPDIYSIVIEGERGNRQRIYSLEQLLQEAVLDVRPQSSRYLPPGTRVCAYWSQKSRCLYPGNVVRGASGDEDEDLDSVVVEFDDGDTGHIAVSNVRLLPPDFKIQCTEPSPALLVSSSCRRTKKVSSEAPPPSEAATPSLSPKAQDGPEALKTPGKKSISKDKAGKAELLTSGAKSPTGASDHFLGRRGSPLLSWSAVAQTKRKAVAAASKGPGVLQNLFQLNGSSKKLRAREALFPVHSVATPIFGNGFRADSFSSLASSYAPFVGGTGPGLPRGAHKLLRAKKAERVEAEKGGRRRAGGEFLVKLDHEGVTSPKNKTCKALLMGDKDFSPKLGRPLPSPSYVHPALVGKDKKGRAPIPPLPMGLALRKYAGQAEFPLPYDSDCHSSFSDEDEDGPGLAAGVPSRFLARLSVSSSSSGSSTSSSSGSVSTSSLCSSDNEDSSYSSDDEDPALLLQTCLTHPVPTLLAQPEALRSKGSGPHAHAQRCFLSRATVAGTGAGSGPSSSSKSKLKRKEALSFSKAKELSRRQRPPSVENRPKISAFLPARQLWKWSGNPTQRRGMKGKARKLFYKAIVRGEETLRVGDCAVFLSAGRPNLPYIGRIESMWESWGSNMVVKVKWFYHPEETKLGKRQCDGKNALYQSCHEDENDVQTISHKCQVVAREQYEQMARSRKCQDRQDLYYLAGTYDPTTGRLVTADGVPILC

SEQ ID NO: 9445 - protein, 419 aa, Homo sapiens
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 9446 - protein, 408 aa, Homo sapiens
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNA

SEQ ID NO: 9447 - protein, 163 aa, Homo sapiens
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGT

SEQ ID NO: 9448 - protein, 419 aa, Homo sapiens; identical to SEQ ID NO: 9445

SEQ ID NO: 9449 - protein, 208 aa, Homo sapiens
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLR

SEQ ID NO: 9450 - protein, 274 aa, Homo sapiens
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKE

SEQ ID NO: 9451 - protein, 161 aa, Homo sapiens
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKALRPHLLSSFSKHGWQKKMPTLLPRL

SEQ ID NO: 9452 - protein, 158 aa, Homo sapiens
MNQEKLAKLQAQVRIGGKGTARRKKKVVHRTATADDKKLQSSLKKLAVNNIAGIEEVNMIKDDGTVIHFNNPKVQASLSANTFAITGHAEAKPITEMLPGILSQLGADSLTSLRKLAEQFPRQVLDSKAPKPEDIDEEDDDVPDLVENFDEASKNEAN

SEQ ID NO: 9453 - protein, 100 aa, Homo sapiens
MIKDDGTVIHFNNPKVQASLSANTFAITGHAEAKPITEMLPGILSQLGADSLTSLRKLAEQFPRQVLDSKAPKPEDIDEEDDDVPDLVENFDEASKNEAN

SEQ ID NO: 9454 - protein, 70 aa, Homo sapiens
MAEVKSMFREVLPKQGPLFVEDIMTMVLCKPKLLPLKSLTLEKLEKMHQAAQNTIRQQEMAEKDQRQITH

SEQ ID NO: 9455 - protein, 70 aa, Homo sapiens; identical to SEQ ID NO: 9454

SEQ ID NO: 9456 - protein, 92 aa, Homo sapiens
MLKAAAKRPELSGKNTISNNSDMAEVKSMFREVLPKQGPLFVEDIMTMVLCKPKLLPLKSLTLEKLEKMHQAAQNTIRQQEMAEKDQRQITH

SEQ ID NO: 9457 - protein, 67 aa, Homo sapiens
MLKAAAKRPELSGPLFVEDIMTMVLCKPKLLPLKSLTLEKLEKMHQAAQNTIRQQEMAEKDQRQITH

SEQ ID NO: 9458 - protein, 103 aa, Homo sapiens
MLKAAAKRPELSGLLKFNNYGILSESPLTSQRTTWLLYQSPSFIPGFAYPSRCLKTIGGVYKQARKKHYIQQLRYGRSEVNVPGSSSKARATVCGRYNDNGAV

SEQ ID NO: 9459 - protein, 292 aa, Homo sapiens
MAVPTELDGGSVKETAAEEESRVLAPGAAPFGNFPHYSRFHPPEQRLRLLPPELLRQLFPESPENGPILGLDVGCNSGDLSVALYKHFLSLPDGETCSDASREFRLLCCDIDPVLVKRAEKECPFPDALTFITLDFMNQRTRKVLLSSFLSQFGRSVFDIGFCMSITMWIHLNHGDHGLWEFLAHLSSLCHYLLVEPQPWKCYRAAARRLRKLGLHDFDHFHSLAIRGDMPNQIVQILTQDHGMELICCFGNTSWDRSLLLFRAKQTIETHPIPESLIEKGKEKNRLSFQKQ

SEQ ID NO: 9460 - protein, 246 aa, Homo sapiens
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 9461 - protein, 246 aa, Homo sapiens; identical to SEQ ID NO: 9460

SEQ ID NO: 9462 - protein, 211 aa, Homo sapiens
MAQAKINAKANEGRFCRSSSMADRSSRLLESLDQLELRVEALREAATAVEQEKEILLEMIHSIQNSQDMRQISDGEREELNLTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 9463 - protein, 108 aa, Homo sapiens
MPHMWVEALREAATAVEQEKEILLEMIHSILTANRLMGRTLTVEVSVETIRNPQQQESLKHATRIIDEVVNKFLDDLGNAKSHLMSLYSACSSEVPHGPVDQKFQSIV

SEQ ID NO: 9464 - protein, 178 aa, Homo sapiens
MPHMWVEALREAATAVEQEKEILLEMIHSIQNSQDMRQISDGEREELNLTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 9465 - protein, 645 aa, Homo sapiens
MSERTQEQDFVIITVDDSDDNNDCSIEMVEVSETADNSTNDIADDSTYVTADNPTDDTATQPNFPGGNDGHHRPLQMSYGSGSVTQAGVQWHDHSSLQPQPLGLKQFFHLSLPSSWDDRRTPPCPVAHGDQIVSQINHPVHLRRYSYNSEEVDFPKRGRFYTPEVQSSISPPAERQETHAWASPAVTSLESAACHELQEADLSESLSYPRIVSSSSLQQYVAQGGSFPCFGMPWNFISGGAESTNAVISFANATTAVPMAVLSRRESSLANNPGVVNYSALPENENVGPGRALSSFCFHPNLESGPQMSYGTMSYSTEMKNNCDQDDASASACLTPDFALLPLNILVKVDTNTENSVNTMNRSTLLDSDSGQDSSSSSVCIPPKYGYLGDPKRNVRVLKIHLLAVQNMAKPKQAACYLVRILFSKEILISSSVDIHLKDSQSLDPNKMAALREYLATTFPTCDLHEHGKDWQDCISGINSMIYCLCSEGKSTPKTVRKNKKRTNRVASASADRNDQRGRDGGEGCSWMFQPMNNSKMREKRNLQPNSNAIPEGMREPSTDNPEEPGEAWSYFGRPWRNIRMPCSVLTLAKTKSCASLSARYLIQKLFTKDVLVQSNVYGNLKHGLCALDPNKISALRGLLHIEYV

SEQ ID NO: 9466 - protein, 799 aa, Homo sapiens
MSERTQEQDFVIITVDDSDDNNDCSIEMVEVSETADNSTNDIADDSTYVTADNPTDDTATQPNFPGGNDGHHRPLQMSYGSGSVTQAGVQWHDHSSLQPQPLGLKQFFHLSLPSSWDDRRTPPCPVAHGDQIVSQINHPVHLRRYSYNSEEVDFPKRGRFYTPEVQSSISPPAERQETHAWASPAVTSLESAACHELQEADLSESLSYPRIVSSSSLQQYVAQGGSFPCFGMPWNFISGGAESTNAVISFANATTAVPMAVLSRRESSLANNPGVVNYSALPENENVGPGRALSSFCFHPNLEMPERPANSSKNSTETANYPTLMGNYNGQNTASLSVFIPPYFAEKIILTEMPGTTETNVENNSQTVYYPALSGNTSAPYPASSYLPITSNFESGPQMSYGTMSYSTEMKNNCDQDDASASACLTPDFALLPLNILVKVDTNTENSVNTMNRSTLLDSDSGQDSSSSSVCIPPKYGYLGDPKRNVRVLKIHLLAVQNMAKPKQAACYLVRILFSKEILISSSVDIHLKDSQSLDPNKMAALREYLATTFPTCDLHEHGKDWQDCISGINSMIYCLCSEGKSTPKTVRKNKKRTNRVASASADRNDQRGRDGGEGCSWMFQPMNNSKMREKRNLQPNSNAIPEGMREPSTDNPEEPGEAWSYFGRPWRNIRMPCSVLTLAKTKSCASLSARYLIQKLFTKDVLVQSNVYGNLKHGLCALDPNKISALREFLQENYPICDLSENGRDWKSCVTSINSGIRSLRHDVRRAEARSQSLPAVTPPELEQESKPGDPDATDPST

SEQ ID NO: 9467 - protein, 828 aa, Homo sapiens
MNSTEFTEDVEEVLKSITVKVETEAEDAALDCSVNSRTSEKHSVDSVLTALQDSSKRKQLVSDGLLDSVPGVKRRRLIPEALLAGMRNRENSSPCQGNGEQAGRGRSLGNVWPGEEEPCNDATTPSYKKPLYGISHKIMEKKNPPSGDLLNVYELFEKANASNSPSSLRLLNEPQKRDCGSTGAGTDNDPNIYFLIQKMFYMLNTLTSNMSQLHSKVDLLSLEVSRIKKQVSPTEMVAKFQPPPEYQLTAAELKQIVDQSLSGGDLACRLLVQLFPELFSDVDFSRGCSACGFAAKRKLESLHLQLIRNYVEVYYPSVKDTAVWQAECLPQLNDFFSRFWAQREMEDSQPSGQVASFFEAEQVDPGHFLDNKDQEEALSLDRSSTIASDHVVDTQDLTEFLDEASSPGEFAVFLLHRLFPELFDHRKLGEQYSCYGDGGKQELDPQRLQIIRNYTEIYFPDMQEEEAWLQQCAQRINDELEGLGLDAGSEGDPPRDDCYDSSSLPDDISVVKVEDSFEGERPGRRSKKIWLVPIDFDKLEIPQPDFEVPGADCLLSKEQLRSIYESSLSIGNFASRLLVHLFPELFTHENLRKQYNCSGSLGKKQLDPSRIKLIRHYVQLLYPRAKNDRVWTLEFVGKLDERCRRRDTEQRRSYQQQRKVHVPGPECRDLTSYAINPERFREEFEGPPLPPERSSKDFCKIPLDELVVPSPDFPVPSPYLLSDKEVREIVQQSLSVGNFAARLLVRLFPELFTAENLRLQYNHSGACNKKQLDPTRLRLIRHYVEAVYPVEKMEEVWHYECIPSIDERCRRPNRKKCDILKKAKKVEK

SEQ ID NO: 9468 - protein, 828 aa, Homo sapiens; identical to SEQ ID NO: 9467

SEQ ID NO: 9469 - protein, 405 aa, Homo sapiens
MQPAEEGPSVPKIYKQRSPYSVLKTFPSLNVVSESRMILDAFAQQCSRVLSLLNCGGKLLDSNHSQSMISCVKQEGSSYNERQEHCHIGKGVHSQTSDNVDIEMQYMQRKQQTSAFLRVFTDSLQNYLLSGSFPTPNPSSASEYGHLADVDPLSTSPVHTLGGWTSPATSESHGHPSSSTLPEEEEEEDEEGYCPRCQELEQEVISLQQENEELRRKLESIPVPCQTVLDYLKMVLQHHNQLLIPQPADQPTEGSKQLLNNYPVYITSKQWDEAVNSSKKDGRRLLRYLIRFVFTTDELKYSCGLGKRKRSVQSGETGPERRPLDPVKVTCLREFIRMHCTSNPDWWMPSEEQINKVFSDAVGHARQGRAVGTFLHNGGSFYEGIDHQASQDEVFNKSSQDGSGD

SEQ ID NO: 9470 - protein, 534 aa, Homo sapiens
MEEEMQPAEEGPSVPKIYKQRSPYSVLKTFPSKRPALAKRYERPTLVELPHVRAPPPPPPPFAPHAAVSISSSEPPPQQFQAQSSYPPGPGRAAAAASSSSPSCTPATSQGHLRTPAQPPPASPAASSSSSFAAVVRYGPGAAAAAGTGGTGSDSASLELSAESRMILDAFAQQCSRVLSLLNCGGKLLDSNHSQSMISCVKQEGSSYNERQEHCHIGKGVHSQTSDNVDIEMQYMQRKQQTSAFLRVFTDSLQNYLLSGSFPTPNPSSASEYGHLADVDPLSTSPVHTLGGWTSPATSESHGHPSSSTLPEEEEEEDEEGYCPRCQELEQEVISLQQENEELRRKLESIPVPCQTVLDYLKMVLQHHNQLLIPQPADQPTEGSKQLLNNYPVYITSKQWDEAVNSSKKDGRRLLRYLIRFVFTTDELKYSCGLGKRKRSVQSGETGPERRPLDPVKVTCLREFIRMHCTSNPDWWMPSEEQINKVFSDAVGHARQGRAVGTFLHNGGSFYEGIDHQASQDEVFNKSSQDGSGD

SEQ ID NO: 9471 - protein, 437 aa, Homo sapiens
MQPAEEGPSVPKIYKQRSPYSVLKTFPSKRPALAKRYERPTLVELPHVRAPPPPPPPFAPHAAVSISSSEPPPQQFQAQSSYPPGPGRAAAAASSSSPSCTPATSQGHLRTPAQPPPASPAASSSSSFAAVVRYGPGAAAAAGTGGTGSDSASLELSAESRMILDAFAQQCSRVLSLLNCGGKLLDSNHSQSMISCVKQEGSSYNERQEHCHIGKGVHSQTSDNVDIEMQYMQRKQQTSAFLRVFTDSLQNYLLSGSFPTPNPSSASEYGHLADVDPLSTSPVHTLGGWTSPATSESHGHPSSSTLPEEEEEEDEEGYCPRCQELEQEVISLQQENEELRRKLESIPVPCQTVLDYLKMVLQHHNQLLIPQPADQPTEGSKQLLNNYPVYITSKQWDEAVNSSKKDGRRLLRYLIRFVFTTDELKYSCGLGKRKRIH

SEQ ID NO: 9472 - protein, 189 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQVLPQAVTQFEELVGMAEALLKGGGTMSTSASTLWRATNNSSPDSFASTCSNSNSNSSSPVSLKPEEEHQTDEKQFQIEKWQNPLLQGTKL

SEQ ID NO: 9473 - protein, 129 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQGNKLDITTEKTILHGGMKTLNVVTTSSHPV

SEQ ID NO: 9474 - protein, 279 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQVLPQAVTQFEELVGMAEALLKGGGTMSTSASTLWRATNNSSPDSFASTCSNSNSNSSSPVSLKPEEEHQTDEKQFQIEKWQIARCNKSKPQKFINDLMQVLYTNEYMATHSLTGAKSSTSRDKAVKPAMNQNEVQEIIGVTKQLFPNTDDVSIRRMIGQKLNNCTKKPNLSKNLNSQDIK

SEQ ID NO: 9475 - protein, 106 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQAWSRELP

SEQ ID NO: 9476 - protein, 129 aa, Homo sapiens; identical to SEQ ID NO: 9473

SEQ ID NO: 9477 - protein, 181 aa, Homo sapiens
MLLPQAVTQFEELVGMAEALLKGGGTMSTSASTLWRATNNSSPDSFASTCSNSNSNSSSPVSLKPEEEHQTDEKQFQIEKWQIARCNKSKPQKFINDLMQVLYTNEYMATHSLTGAKSSTSRDKAVKPAMNQNEVQEIIGVTKQLFPNTDDVSIRRMIGQKLNNCTKKPNLSKNLNSQDIK

SEQ ID NO: 9478 - protein, 468 aa, Homo sapiens
MEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSAEIADSDERLDGIALPPTGACGGPCTVLPGGSAAVTLVLQSSPQTMSQEKGQMAEPWEEQHLVLLNNLTRDRAETGALSQTSQDFKHHSFLITQVSATLHHQRGIRNFPTPGSAKSLTLHISCLSL

SEQ ID NO: 9479 - protein, 374 aa, Homo sapiens
MEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGMVVNKHSEGSHGGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTVV

SEQ ID NO: 9480 - protein, 426 aa, Homo sapiens
MEFSERKRSRKSQSFKLVSRDYHHEVYKIPEFSNDVNGEAKETQPIFLGDESMEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGMVVNKHSEGSHGGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTVV

SEQ ID NO: 9481 - protein, 519 aa, Homo sapiens
MEFSERKRSRKSQSFKLVSRDYHHEVYKIPEFSNDVNGEAKETQPIFLGDESMEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTGACGGPCTVLPGGSAAVTLVLQSSPQTMSQEKGQMAEPWEEQHLVLLNNLTRDRAETGALSQTSQDFKHHSFLITQVSATLHHQRGIRNFPTPGSAKSLTLHISCLSL

SEQ ID NO: 9482 - protein, 117 aa, Homo sapiens
LDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTGK

SEQ ID NO: 9483 - protein, 1022 aa, Homo sapiens
MPDFQPGDTTVRLDKRMSLTAIYDKRRETDYSDKGYNLAFVSQDEQENSSFTILYEEPLQEEDKYASAEARQTQSVLFHDTSADSMPVLACERSESRTDLVHHFEKGTKLGETFDSDSSEMFLSVEAKRYKIYPLALSPIYEDDSSQEDILSSEVSPGHHGPRKSRDSENQSSSVLSLLQSVSERLKMNFDEDDREAADEEEEEEEAAVLHKGDLRAGSGERVTFQLPDPSITFYPDDQESVGISKNSYVMPNEPTTSNLQVGLWPEKTSFLQKSDLTSKLHSSLKSAYHQYLQTSQSHSSEKGARFGGIFQEPVSKYFRVQDSPGRLSPFIENVDKQTLRCNPRPGKMVIYDLHESTYKQEVYCNIPDATSWSFPNGVLIKVVRGCWILYEKPHFRGQKCVLEEGEKVLNRDWILQNRRHPQRNFILGSLKRVLKDCSIPEIELFPQSDPACCPVYIQRAVPNLEELNISKSVSFTVKSGVWLAYPDINFKGQATVLEEDHGLFEISTAEMKSLHPLQMGGLKVEMPMNLKVIIYEKPHFHGQAKEFSEHIDSVPNFLKNNGDFHRIGSIRVIGGVWVAYEKEHFKGQQFLLEEGDFEDSNACGALSSPILSFRYLQANFIESSVTLFESDLESGKFIDITNQEISDLEEIGFGSKTRSIHVKSGVWVAYQQKFFCGEQYILEKGKYKCFFDWGGSNNIIMSIRPIQLEPLGINEPPHLLKAFSKPGFQGECIDFTEETSDLTSLMPCSFKVLRGCWLLYYQEDMFVNHCVLEEGLYADLTSCGCPASKVKSLKPIDYVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGKNTQIWYYCRGLFKSKASDTCLDVIGGRDTPGAKVALWTEHGQFRQKWRLNKNGTISSYLSDQLVLDVKGGNYCDKTHVIVNQPLEGEETQKWDIEIL

SEQ ID NO: 9484 - protein, 229 aa, Homo sapiens
MNEKKKVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGKNTQIWYYCRGLFKSKASDTCLDVIGGRDTPGAKVALWTEHGQFRQKWRLNKNGTISSYLSDQLVLDVKGGNYCDKTHVIVNQPLEGEETQKWDIEIL

SEQ ID NO: 9485 - protein, 131 aa, Homo sapiens
MNKKKVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGK

SEQ ID NO: 9486 - protein, 3051 aa, Homo sapiens
MATNPQPQPPPPAPPPPPPQPQPQPPPPPPGPGAGPGAGGAGGAGAGAGDPQLVAMIVNHLKSQGLFDQFRRDCLADVDTKPAYQNLRQRVDNFVANHLATHTWSPHLNKNQLRNNIRQQVLKSGMLESGIDRIISQVVDPKINHTFRPQVEKAVHEFLATLNHKEEGSGNTAPDDEKPDTSLITQGVPTPGPSANVANDAMSILETITSLNQEASAARASTETSNAKTSERASKKLPSQPTTDTSTDKERTSEDMADKEKSTADSGGEGLETAPKSEEFSDLPCPVEEIKNYTKEHNNLILLNKDVQQESSEQKNKSTDKGEKKPDSNEKGERKKEKKEKTEKKFDHSKKSEDTQKVKDEKQAKEKEVESLKLPSEKNSNKAKTVEGTKEDFSLIDSDVDGLTDITVSSVHTSDLSSFEEDTEEEVVTSDSMEEGEITSDDEEKNKQNKTKTQTSDSSEGKTKSVRHAYVHKPYLYSKYYSDSDDELTVEQRRQSIAKEKEERLLRRQINREKLEEKRKQKAEKTKSSKTKGQGRSSVDLEESSTKSLEPKAARIKEVLKERKVLEKKVALSKKRKKDSRNVEENSKKKQQYEEDSKETLKTSEHCEKEKISSSKELKHVHAKSEPSKPARRLSESLHVVDENKNESKLEREHKRRTSTPVIMEGVQEETDTRDVKRQVERSEICTEEPQKQKSTLKNEKHLKKDDSETPHLKSLLKKEVKSSKEKPEREKTPSEDKLSVKHKYKGDCMHKTGDETELHSSEKGLKVEENIQKQSQQTKLSSDDKTERKSKHRNERKLSVLGKDGKPVSEYIIKTDENVRKENNKKERRLSAEKTKAEHKSRRSSDSKIQKDSLGSKQHGITLQRRSESYSEDKCDMDSTNMDSNLKPEEVVHKEKRRTKSLLEEKLVLKSKSKTQGKQVKVVETELQEGATKQATTPKPDKEKNTEENDSEKQRKSKVEDKPFEETGVEPVLETASSSAHSTQKDSSHRAKLPLAKEKYKSDKDSTSTRLERKLSDGHKSRSLKHSSKDIKKKDENKSDDKDGKEVDSSHEKARGNSSLMEKKLSRRLCENRRGSLSQEMAKGEEKLAANTLSTPSGSSLQRPKKSGDMTLIPEQEPMEIDSEPGVENVFEVSKTQDNRNNNSQQDIDSENMKQKTSATVQKDELRTCTADSKATAPAYKPGRGTGVNSNSEKHADHRSTLTKKMHIQSAVSKMNPGEKEPIHRGTTEVNIDSETVHRMLLSAPSENDRVQKNLKNTAAEEHVAQGDATLEHSTNLDSSPSLSSVTVVPLRESYDPDVIPLFDKRTVLEGSTASTSPADHSALPNQSLTVRESEVLKTSDSKEGGEGFTVDTPAKASITSKRHIPEAHQATLLDGKQGKVIMPLGSKLTGVIVENENITKEGGLVDMAKKENDLNAEPNLKQTIKATVENGKKDGIAVDHVVGLNTEKYAETVKLKHKRSPGKVKDISIDVERRNENSEVDTSAGSGSAPSVLHQRNGQTEDVATGPRRAEKTSVATSTEGKDKDVTLSPVKAGPATTTSSETRQSEVALPCTSIEADEGLIIGTHSRNNPLHVGAEASECTVFAAAEEGGAVVTEGFAESETFLTSTKEGESGECAVAESEDRAADLLAVHAVKIEANVNSVVTEEKDDAVTSAGSEEKCDGSLSRDSEIVEGTITFISEVESDGAVTSAGTEIRAGSISSEEVDGSQGNMMRMGPKKETEGTVTCTGAEGRSDNFVICSVTGAGPREERMVTGAGVVLGDNDAPPGTSASQEGDGSVNDGTEGESAVTSTGITEDGEGPASCTGSEDSSEGFAISSESEENGESAMDSTVAKEGTNVPLVAAGPCDDEGIVTSTGAKEEDEEGEDVVTSTGRGNEIGHASTCTGLGEESEGVLICESAEGDSQIGTVVEHVEAEAGAAIMNANENNVDSMSGTEKGSKDTDICSSAKGIVESSVTSAVSGKDEVTPVPGGCEGPMTSAASDQSDSQLEKVEDTTISTGLVGGSYDVLVSGEVPECEVAHTSPSEKEDEDIITSVENEECDGLMATTASGDITNQNSLAGGKNQGKVLIISTSTTNDYTPQVSAITDVEGGLSDALRTEENMEGTRVTTEEFEAPMPSAVSGDDSQLTASRSEEKDECAMISTSIGEEFELPISSATTIKCAESLQPVAAAVEERATGPVLISTADFEGPMPSAPPEAESPLASTSKEEKDECALISTSIAEECEASVSGVVVESENERAGTVMEEKDGSGIISTSSVEDCEGPVSSAVPQEEGDPSVTPAEEMGDTAMISTSTSEGCEAVMIGAVLQDEDRLTITRVEDLSDAAIISTSTAECMPISASIDRHEENQLTADNPEGNGDLSATEVSKHKVPMPSLIAENNCRCPGPVRGGKEPGPVLAVSTEEGHNGPSVHKPSAGQGHPSAVCAEKEEKHGKECPEIGPFAGRGQKESTLHLINAEEKNVLLNSLQKEDKSPETGTAGGSSTASYSAGRGLEGNANSPAHLRGPEQTSGQTAKDPSVSIRYLAAVNTGAIKADDMPPVQGTVAEHSFLPAEQQGSEDNLKTSTTKCITGQESKIAPSHTMIPPATYSVALLAPKCEQDLTIKNDYSGKWTDQASAEKTGDDNSTRKSFPEEGDIMVTVSSEENVCDIGNEESPLNVLGGLKLKANLKMEAYVPSEEEKNGEILAPPESLCGGKPSGIAELQREPLLVNESLNVENSGFRTNEEIHSESYNKGEISSGRKDNAEAISGHSVEADPKEVEEEERHMPKRKRKQHYLSSEDEPDDNPDVLDSRIETAQRQCPETEPHDTKEENSRDLEELPKTSSETNSTTSRVMEEKDEYSSSETTGEKPEQNDDDTIKSQEEDQPIIIKRKRGRPRKYPVETTLKMKDDSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRSKTQLSPSIKRKREVSPPGARTRGQQRVEEAPVKKAKR

SEQ ID NO: 9487 - protein, 172 aa, Homo sapiens
MADGGGGGSGGAGPASTRASGGGGPINPASLPPGDPQLIAIIVGQLKSRGLFDSFRRDCKADVDTKPAYQNLSQKADNFVSTHLDKQEWNPPANDNQLHDGLRQSVVQSGRSEAGVDRISSQVVDPKLNHIFRPQIEQIIHEFLVAQKEAAVPALPPEPEGQDPPAPSQDTS

SEQ ID NO: 9488 - protein, 137 aa, Homo sapiens
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSPPCLGGNKKTLGTP

SEQ ID NO: 9489 - protein, 152 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRLVNACLAEELPHIHAFEQKTLTPDQWARERQK

SEQ ID NO: 9490 - protein, 530 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERR

SEQ ID NO: 9491 - protein, 489 aa, Homo sapiens
MNKLSPVLLFLNQQNYQIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 9492 - protein, 559 aa, Homo sapiens
MGDVKESKMQITPETPGRIPVLNPFESPSDYSNLHEQTLASPSVFKSTKLPTPGKFRWSIDQLAVINPVEIDPEDIHRQALYLSHSRIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 9493 - protein, 668 aa, Homo sapiens
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGIIPKS

SEQ ID NO: 9494 - protein, 696 aa, Homo sapiens
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQSKAMFSKSLDIAEAHPQFSKEDRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 9495 - protein, 766 aa, Homo sapiens
MSPEGHPSRWARPRRPCICPSSLCSPREPRSGPAVGRGGAAHHRVPAGHTPGPQLLQPHLHLPQGQTWLCLQPSPAGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCDEKNGQAAQAPSTPAKRSAHGPLGDSAAAGPGPGGDAEYPTGKDTAKMGPPTARREQP

SEQ ID NO: 9496 - protein, 696 aa, Homo sapiens; identical to SEQ ID NO: 9494

SEQ ID NO: 9497 - protein, 736 aa, Homo sapiens
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGSPLSNFFDVIKQLFSDEKNGQAAQAPSTPAKRSAHGPLGDSAAAGPGPGGDAEYPTGKDTAKMGPPTARREQP

SEQ ID NO: 9498 - protein, 674 aa, Homo sapiens
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 9499 - protein, 369 aa, Homo sapiens
MHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 9500 - protein, 111 aa, Homo sapiens
MENVPKENKVVEKAPVQNEAPALGGGEYQEPGGNVKGVWAPPAPGFGEDVPNRLVDNIDMIDGDGDDMERFMEEMRELRRKIRELQLRYSLRILIGDPPHHDHHDEFCLMP

SEQ ID NO: 9501 - protein, 111 aa, Homo sapiens; identical to SEQ ID NO: 9500

SEQ ID NO: 9502 - protein, 825 aa, Homo sapiens
MAAGKFASLPRNMPVNHQFPLASSMDLLSSRSPLAEHRPDAYQDVSIHGTLPRKKKGPPPIRSCDDFSHMGTLPHSKSPRQNSPVTQDGIQESPWQDRHGETFTFRDPHLLDPTVEYVKFSKERHIMDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 9503 - protein, 825 aa, Homo sapiens; identical to SEQ ID NO: 9502

SEQ ID NO: 9504 - protein, 825 aa, Homo sapiens; identical to SEQ ID NO: 9502

SEQ ID NO: 9505 - protein, 734 aa, Homo sapiens
MPKECSAFHALSAALCCFYHRKSFIGVKFSKERHIMDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 9506 - protein, 501 aa, Homo sapiens
MQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 9507 - protein, 1483 aa, Homo sapiens
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 9508 - protein, 501 aa, Homo sapiens
MKGYQSLVFNFFFLKLSAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKERLLALKRSMSFMQDMDFSQQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 9509 - protein, 186 aa, Homo sapiens
AVCSLRLPSSPDKRSRAMQVTLILAEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSL

SEQ ID NO: 9510 - protein, 481 aa, Homo sapiens
MKGYQSLVFNFFFLKLSAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 9511 - protein, 214 aa, Homo sapiens
MKGYQSLVFNFFFLKLSAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKRRRPTRWT

SEQ ID NO: 9512 - protein, 597 aa, Homo sapiens
MGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 9513 - protein, 544 aa, Homo sapiens
MMTGQTMSERGTKKRKRRRRRSPRRRSIWTMRKEGSERKRRSGSERGSTVTRRERLTTLILGRRWRWSRPQIGQSERAGHSQPKMRAHLFSNSWNTSSASFRDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 9514 - protein, 145 aa, Homo sapiens
MLGWIQPSRQPQLRAAPPTRTPSAKRCILCNFLPGCWLVGDVAGSRQPSAPQTLRQRQHTRPPPQERGSGRRSPLREARRANPHFKSFPVLEARGLPCGARRTGPRRPVREMTLPSDPERATLPNPRLGAPAVPRRGPRSHGGRR

SEQ ID NO: 9515 - protein, 173 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDACQPELWAQILVAPCWPSWASAHTWEGAL

SEQ ID NO: 9516 - protein, 474 aa, Homo sapiens
MAEGEDVGWWRSWLQQSYQAVKEKSSEALEFMKRDLTEFTQVVQHDTACTIAATASVVKEKLAIAACSRGACFLCPFSIQTEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGEVSGPGGSEGSEPNGPGCESSPQPAQLSPQEGPCSCLR

SEQ ID NO: 9517 - protein, 369 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9518 - protein, 374 aa, Homo sapiens
MAEGEDVGWWRSWLQQSYQAVKEKSSEALEFMKRDLTEFTQVVQHDTACTIAATASVVKEKLAARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9519 - protein, 447 aa, Homo sapiens
MAEGEDVGWWRSWLQQSYQAVKEKSSEALEFMKRDLTEFTQVVQHDTACTIAATASVVKEKLAIAACSRGACFLCPFSIQTEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9520 - protein, 422 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKETRSQFTVDFLWKISVTLLEPLGQSASPLFSNLPFPR

SEQ ID NO: 9521 - protein, 430 aa, Homo sapiens
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9522 - protein, 335 aa, Homo sapiens
MAEGEDVGWWRSWLQQSYQAVKEKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9523 - protein, 385 aa, Homo sapiens
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRSLNMRKSKPWDRMIPALVVMGQLTHSGSCSRNP

SEQ ID NO: 9524 - protein, 506 aa, Homo sapiens
MIMSNTHKARLERRVTGSTNRWRLPKQPFSGDLLSLSQMCKALSIDFEEALRNPDRLCISQIQKFFFENFKNKDIQSGEADVILECLGFKWELHQPQLFQSETLAKLYLKALAQGTTHPLRELEELLRAQSPKKTKEKSPAKRIIISLKINDPLVTKVAFATALKNLYMSEVEINLEDLLGVLASAHILQFSGLFQRCVDVMIARLKPSTIKKFYEAGCKYKEEQLTTGCEKWLEMNLVPLGGTQIHLHKIPQDLLHKVLKSPRLFTFSEFHLLKTMLLWVFLQLNYKIQAIPTYETVMTFFKSFPENCCFLDRDIGRSLRPLFLCLRLHGITKGKDLEVLRHLNFFPESWLDQVTVNHYHALENGGDMVHLKDLNTQAVRFGLLFNQENTTYSKTIALYGFFFKIKGLKHDTTSYSFYMQRIKHTDLESPSAVYEHNHVSLRAARLVKYEIRAEALVDGKWQEFRTNQIKQKFGLTTSSCKSHTLKIQTVGIPIYVSFAFIFPAS

SEQ ID NO: 9525 - protein, 507 aa, Homo sapiens
MIMSNTQHKARLERRVTGSTNRWRLPKQPFSGDLLSLSQMCKALSIDFEEALRNPDRLCISQIQKFFFENFKNKDIQSGEADVILECLGFKWELHQPQLFQSETLAKLYLKALAQGTTHPLRELEELLRAQSPKKTKEKSPAKRIIISLKINDPLVTKVAFATALKNLYMSEVEINLEDLLGVLASAHILQFSGLFQRCVDVMIARLKPSTIKKFYEAGCKYKEEQLTTGCEKWLEMNLVPLGGTQIHLHKIPQDLLHKVLKSPRLFTFSEFHLLKTMLLWVFLQLNYKIQAIPTYETVMTFFKSFPENCCFLDRDIGRSLRPLFLCLRLHGITKGKDLEVLRHLNFFPESWLDQVTVNHYHALENGGDMVHLKDLNTQAVRFGLLFNQENTTYSKTIALYGFFFKIKGLKHDTTSYSFYMQRIKHTDLESPSAVYEHNHVSLRAARLVKYEIRAEALVDGKWQEFRTNQIKQKFGLTTSSCKSHTLKIQTVGIPIYVSFAFIFPAS

SEQ ID NO: 9526 - protein, 712 aa, Homo sapiens
MCSPASPKILYRNPRFLRLAFLQLHHQQQSDVFCDVLLQAEGEAVPAHCCILSACSPFFTERLERERPAQGGKVVLELGGLKISTLRKLVDFLYTSEMEVSQEEAQDVLSAARQLRVSELESLQLEGGKLVKAPQGRRLNRECLQPTSAAPISARVVTPSHHPHTPLPTNQTPCPLGAIRLKSLGKEEGPQENNRQNADNLSGTLLLKRKARACPTPQEKNSSPSSHSQEPRENKNDTALDPTVLSPPSLYPSVDKHLLPRKIRLSRSKPSPGICTSKPSSILSGSSSVPATPGRRLWRQRSVNKETPEDKPKPGRASPLQSTPNPSGLGKTGGSRKRSPEVRAPNSDSAEEGQVGRVKLRKIVNGTCWEVVQETPLKNTQDSPQIPDPGGDFQEPSGTQPFSSNEQEMSPTRTELCQDSPMCTKLQDILVSASHSPDHPVVKSEFESSPELVEKEPMLAIDCREPYAFDTALLEQPCEAEEYRITSAAATSELEEILDFMLCGSDIEPPIGSLESPGAEGCRTPTYHLTETGKNWIEGEEWCLPDMELWPRELTELEKEPAGENRGPTELLSPLVMPSEVSEVLSVGGRWTPDLEITSSQPLDGQEDKLLHVSSLDTPQRSYGDLSPPCSNWVETGLEVSLTTDELLYPSPKAGKEVSGHSELLGSLPASSEEEEIDVVDWTAEGRLVPTTVPSVWPDPSSESETEVDILT

SEQ ID NO: 9527 - protein, 712 aa, Homo sapiens; identical to SEQ ID NO: 9526

SEQ ID NO: 9528 - protein, 89 aa, Homo sapiens
MCSPASPKILYRNPRFLRLAFLQLHHQQQSDVFCDVLLQAEGEAVPAHCCILSACSPFFTERLERERPAQGGKVVLELGGLKISTLRKL

SEQ ID NO: 9529 - protein, 291 aa, Homo sapiens
MEPLGLVVHGKAEPFSAALRSLVNNPRYSDVCFVVGQERQEVFAHRCLLACRCNFFQRLLGTEPGPGVPSPVVLSTVPTEAFLAVLEFLYTNSVKLYRHSVLEVLTAAVEYGLEELRELCLQFVVKVLDVDLVCEALQVAVTFGLGQLQERCVAFIEAHSQEALRTRGFLELSAAALLPLLRSDKLCVDEAELVRAARSWARVGAAVLERPVAEVAAPVVKELRLALLAPAELSALEEQNRQEPLIPVEQIVEAWKCHALRRGDEARGAPCRRRRGTLPREHHRFLDLSFK

SEQ ID NO: 9530 - protein, 162 aa, Homo sapiens
MEPLGLVVHGKAEPFSAALRSLVNNPRYSDVCFVVGQERQEVFAHRCLLACRCNFFQRLLGTEPGPGVPSPVVLSTVPTEAFLAVLEFLYTNSVKLYRHSVLEVLTAAVEYGLEELRELCLQFVVKVLDVDLVCEALQHFWRPRRADQEVRRSRPSWLTRWP

SEQ ID NO: 9531 - protein, 461 aa, Homo sapiens
MAADIFPRKKPANSSSTSVQQYHQQNLSNNNLIPAPNWQGLYPTIRERNAMMFNNDLMADVHFVVGPPGGTQRLPGHKYVLAVGSSVFHAMFYGELAEDKDEIRIPDVEPAAFLAMLKYIYCDEIDLAADTVLATLYAAKKYIVPHLARACVNFLETSLSAKNACVLLSQSCLFEEPDLTQRCWEVIDAQAELALKSEGFCDIDFQTLESILRRETLNAKEIVVFEAALNWAEVECQRQDLALSIENKRKVLGKALYLIRIPTMALDDFANGAAQSGVLTLNETNDIFLWYTAAKKPELQFVSKARKGLVPQRCHRFQSCAYRSNQWRYRGRCDSIQFAVDKRVFIAGFGLYGSSCGSAEYSAKIELKRQGVVLGQNLSKYFSDGSSNTFPVWFEYPVQIEPDTFYTASVILDGNELSYFGQEGMTEVQCGKVTVQFQCSSDSTNGTGVQGGQIPELIFYA

SEQ ID NO: 9532 - protein, 522 aa, Homo sapiens
MVDDKEKNMKCLTFFLMLPETVKNRSKKSSKKANTSSSSSNSSKLPPVCYEIITLKTKKKKMAADIFPRKKPANSSSTSVQQYHQQNLSNNNLIPAPNWQGLYPTIRERNAMMFNNDLMADVHFVVGPPGGTQRLPGHKYVLAVGSSVFHAMFYGELAEDKDEIRIPDVEPAAFLAMLKYIYCDEIDLAADTVLATLYAAKKYIVPHLARACVNFLETSLSAKNACVLLSQSCLFEEPDLTQRCWEVIDAQAELALKSEGFCDIDFQTLESILRRETLNAKEIVVFEAALNWAEVECQRQDLALSIENKRKVLGKALYLIRIPTMALDDFANGAAQSGVLTLNETNDIFLWYTAAKKPELQFVSKARKGLVPQRCHRFQSCAYRSNQWRYRGRCDSIQFAVDKRVFIAGFGLYGSSCGSAEYSAKIELKRQGVVLGQNLSKYFSDGSSNTFPVWFEYPVQIEPDTFYTASVILDGNELSYFGQEGMTEVQCGKVTVQFQCSSDSTNGTGVQGGQIPELIFYA

SEQ ID NO: 9533 - protein, 461 aa, Homo sapiens; identical to SEQ ID NO: 9531

SEQ ID NO: 9534 - protein, 522 aa, Homo sapiens; identical to SEQ ID NO: 9532

SEQ ID NO: 9535 - protein, 136 aa, Homo sapiens
MAADIFPRKKPANSSSTSVQQYHQQNLSNNNLIPAPNWQGLYPTIRERNAMMFNNDLMADVHFVVGPPGGTQRLPGHKYVLAVGSSVFHAMFYGELAEDKDEIRIPDVEPAAFLAMLKYIYCDEIDLAADTVLATL

SEQ ID NO: 9536 - protein, 2 aa, Homo sapiens
MA

SEQ ID NO: 9537 - protein, 619 aa, Homo sapiens
MAAAPPLSKAEYLKRYLSGADAGVDRGSESGRKRRKKRPKPGGAGGKGMRIVDDDVSWTAISTTKLEKEEEEDDGDLPVVAEFVDERPEEVKQMEAFRSSAKWKLLGGHNEDLPSNRHFRHDTPDSSPRRVRHGTPDPSPRKDRHDTPDPSPRRARHDTPDPSPLRGARHDSDTSPPRRIRHDSSDTSPPRRARHDSPDPSPPRRPQHNSSGASPRRVRHDSPDPSPPRRARHGSSDISSPRRVHNNSPDTSRRTLGSSDTQQLRRARHDSPDLAPNVTYSLPRTKSGKAPERASSKTSPHWKESGASHLSFPKNSKYEYDPDISPPRKKQAKSHFGDKKQLDSKGDCQKATDSDLSSPRHKQSPGHQDSDSDLSPPRNRPRHRSSDSDLSPPRRRQRTKSSDSDLSPPRRSQPPGKKAAHMYSGAKTGLVLTDIQREQQELKEQDQETMAFEAEFQYAETVFRDKSGRKRNLKLERLEQRRKAEKDSERDELYAQWGKGLAQSRQQQQNVEDAMKEMQKPLARYIDDEDLDRMLREQEREGDPMANFIKKNKAKENKNKKVRPRYSGPAPPPNRFNIWPGYRWDGVDRSNGFEQKRFARLASKKAVEELAYKWSVEDM

SEQ ID NO: 9538 - protein, 485 aa, Homo sapiens
MAAAPPLSKAEYLKRYLSGADAGVDRGSESGRKRRKKRPKPGGAGGKGMRIVDDDVSWTAISTTKLEKEEEEDDGDLPVVAEFVDERPEEVKQMEAFRSSAKWKLLGGHNEDLPSNRHFRHDTPDSSPRRVRHGTPDPSPRKDRHDTPDPSPRRARHDTPDPSPLRGARHDSDTSPPRRIRHDSSDTSPPRRARHDSPDPSPPRRPQHNSSGDCQKATDSDLSSPRHKQSPGHQDSDSDLSPPRNRPRHRSSDSDLSPPRRRQRTKSSDSDLSPPRRSQPPGKKAAHMYSGAKTGLVLTDIQREQQELKEQDQETMAFEAEFQYAETVFRDKSGRKRNLKLERLEQRRKAEKDSERDELYAQWGKGLAQSRQQQQNVEDAMKEMQKPLARYIDDEDLDRMLREQEREGDPMANFIKKNKAKENKNKKVRPRYSGPAPPPNRFNIWPGYRWDGVDRSNGFEQKRFARLASKKAVEELAYKWSVEDM

SEQ ID NO: 9539 - protein, 199 aa, Homo sapiens
APGRLASRPPPPPARRWRLAAPRYSSASGPSGPAARLCAETQGEAPRGPRAVGGSGGAGEPRWSRGPAQRERLLGCSCCFPSFFTGTCSFRTSWSAFTLELTSSIPAPLPPPPAALSLSQQQGKSRRKEASTPLTPAEAPAYSRARPRRQGSPSAGPEAPLATDEPPPQRRSGIRGGSANIRSLQPSSLRPSAHRGSAL

SEQ ID NO: 9540 - protein, 394 aa, Homo sapiens
MSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLEKSEGGLSAAPARAVSAVKNINLPEIPRNINIGDLNIKVPNLSQFV

SEQ ID NO: 9541 - protein, 391 aa, Homo sapiens
MAGSMVTPLLYRRKLRPGERKMRPEVGREPAALQPRQRPRSDHQLHRSPFTVPPRTPACRSPGPSPPIAVALEVKPQLEDAVGKLAAEAVAVRVFPLAVDDLESDVLVGRPRVEAQDGEILVVGAGLQEVLGRGALVDEVGVEDVELVSLHDLGRWVVKVVVRLVVLVPLEARVHAVEEARLAWPVLVGPQVGLAGEWHLHAELRLVLAHALLGPPEEDVLGALAGVSRDLELLARELQALQVLIRFQHVRVQWQLVRREQPRAVPAGVVVVQALLDQVLLHEHRLALALALTVPVAVALCRGRAVHLGLRGAALRGGPGRGGRRVLRLQAAAGGLGLLLEDGEQRLALHALLLLQFVQLLPQHVLVALTQPSAHRARAMWARSCCRRLSQ

SEQ ID NO: 9542 - protein, 353 aa, Homo sapiens
MWLLEKAGYKVGAAEPAARWAPSGLFSKRRAPGPPTSACPNVLTPDRIPQFFIPPRLPDPGGAVPAARRHVAGRGLPATCSLPHLAGREGWAFLPESPHTRRRESLFHGPPPAPAGGLPAAQSRLHVSAPDLRLCRAPDSDTASSPDSSPFGSPRPGLGRRRVSRPHSLSPEKASSADTSPHSPRRAGPPTPPLFHLDFLCCQLRPTRESVLRLGPRGGQLRLSTEYQAGPGRLRLRLVSAEGLPRPRSRPGSGGGGCCVVLRLRPRVRPREQQSRVVKCSANPIFNEDFFFDGLGPPDLAARSLRAKVLDRGAGLRRDVLLGECETPLIALLPPLGGGLGPGSSLAPTHLSL

SEQ ID NO: 9543 - protein, 707 aa, Homo sapiens
MDPGWGQRDVGWAALLILFAASLLTVFAWLLQYARGLWLARARGDRGPGPALAGEPAGSLRELGVWRSLLRLRATRAGAAEEPGVRGLLASLFAFKSFRENWQRAWVRALNEQACRNGSSIQIAFEEVPQLPPRASISHVTCVDQSEHTMVLRCQLSAEEVRFPVSVTQQSPAAVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSPGDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 9544 - protein, 279 aa, Homo sapiens
MINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKSKYNVYVYILTSPENEFPLIFDRPSYVFDVSERRPAQGHLSGPEEKRLLSICMVRAVCHHFGLHIASGSPRVPGRPIGQSHPQTLPLQDWEEQGTSVREIPNEDCRERRRGGNYPDEHYL

SEQ ID NO: 9545 - protein, 318 aa, Homo sapiens
YTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPAQGHLSGPEEKRLLSICMVRAVCHHFGLHIASGSPRVPGRPIGQSHPQTLPLQDWEEQGTSDKERRNEDCRERRRGGNYPDEHYL

SEQ ID NO: 9546 - protein, 149 aa, Homo sapiens
MQEAIILLALLGAMSGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEARHECTQSWRN

SEQ ID NO: 9547 - protein, 885 aa, Homo sapiens
MQEAIILLALLGAMSGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVPFVITLGSILLLGLLVYLVVLLAKAIHRHCPCKTGKNKEPLKKKTETKTAERDVVVETIQMNTIFDGEAIDPVTGETYEFNSKTGARKWKDPLTQMPKWKESSHQGAAPRRVTAGEGMGSLRSANWEEDELSGKAWAEDAGLGSRNEGGKLGNPKNRNPAFMNRAYPKPHPGK

SEQ ID NO: 9548 - protein, 314 aa, Homo sapiens
MSAAEAGGVFHRARGRTLAAFPAEKESEWKGPFYFILGADPQFGLIKAWSTGDCDNGGDEWEQEIRLTEQAVQAINKLNPKPKFFVLCGDLIHAMPGKPWRTEQTEDLKRVLRAVDRAIPLVLVSGNHDIGNTPTAETVEEFCRTWGDDYFSFWVGGVLFLVLNSQFYENPSKCPSLKQAQDQWLDEQLSIARQRHCQHAIVFQHIPLFLESIDEDDDYYFNLSKSTRKKLADKFIHAGVKVVFSGHYHRNAGGTYQNLDMVVSSAIGCQLGRDPHGLRVVVVTAEKIVHRYYSLDELSEKGIEDDLMDLIKKK

SEQ ID NO: 9549 - protein, 172 aa, Homo sapiens
MSAAEAGGVFHRARGRTLAAFPAEKESEWKGPFYFILGADPQFGLIKAWSTGDCDNGGDEWEQEIRLTEQAVQAINKLNPKPKFFVLCGDLIHAMPGVKVVFSGHYHRNAGGTYQNLDMVVSSAIGCQLGRDPHGLRVVVVTAEKIVHRYYSLDELSEKGIEDDLMDLIKKK

SEQ ID NO: 9550 - protein, 141 aa, Homo sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 9551 - protein, 187 aa, Homo sapiens
MGNKQTIFTEEQLDNYQDCTFFNKKDILKLHSRFYELAPNLVPMDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 9552 - protein, 187 aa, Homo sapiens
MGNKQTVFTHEQLEAYQDCTFFTRKEIMRLFYRYQDLAPQLVPLDYTTCPDVKVPYELIGSMPELKDNPFRQRIAQVFSEDGDGHMTLDNFLDMFSVMSEMAPRDLKAYYAFKIYDFNNDDYICAWDLEQTVTKLTRGGLSAEEVSLVCEKVLDEADGDHDGRLSLEDFQNMILRAPDFLSTFHIRI

SEQ ID NO: 9553 - protein, 138 aa, Homo sapiens
MGNKQTVFTHEQLEAYQDNPFRQRIAQVFSEDGDGHMTLDNFLDMFSVMSEMAPRDLKAYYAFKIYDFNNDDYICAWDLEQTVTKLTRGGLSAEEVSLVCEKVLDEADGDHDGRLSLEDFQNMILRAPDFLSTFHIRI

SEQ ID NO: 9554 - protein, 30 aa, Homo sapiens
MGNKQTVFTHEQLEAYQDCTFFTRKEIMRF

SEQ ID NO: 9555 - protein, 185 aa, Homo sapiens
MGQCLRYQMHWEDLEEYQALTFLTRNEILCIHDTFLKLCPPGKYYKEATLTMDQVSSLPALRVNPFRDRICRVFSHKGMFSFEDVLGMASVFSEQACPSLKIEYAFRIYDFNENGFIDEEDLQRIILRLLNSDDMSEDLLMDLTNHVLSESDLDNDNMLSFSEFEHAMAKSPDFMNSFRIHFWGC

SEQ ID NO: 9556 - protein, 149 aa, Homo sapiens
MAAEHLLPGPPPSLADFRLEAGGKGTERGSGSSKPTGSSRGPRMAKFLSQDQINDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 9557 - protein, 196 aa, Homo sapiens
MAAEHLLPGPPPSLADFRLEAGGKGTERGSGSSKPTGSSRGPRMAKFLSQDQINEYKECFSLYDKQQRGKIKATDLMVAMRCLGASPTPGEVQRHLQTHGIDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 9558 - protein, 120 aa, Homo sapiens
MVAMRCLGASPTPGEVQRHLQTHGIDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 9559 - protein, 146 aa, Homo sapiens
MAGELTPEEEAQYKKAFSAVDTDGNGTINAQELGAALKATGKNLSEAQLRKLISEVDSDGDGEISFQEFLTAAKKARAGLEDLQVAFRAFDQDGDGHITVDELRRAMAGLGQPLPQEELDAMIREADVDQDGRVNYEEFARMLAQE

SEQ ID NO: 9560 - protein, 669 aa, Homo sapiens
MAYYQEPSVETSIIKFKDQDFTTLRDHCLSMGRTFKDETFPAADSSIGQKLLQEKRLSNVIWKRPQDLPGGPPHFILDDISRFDIQQGGAADCWFLAALGSLTQNPQYRQKILMVQSFSHQYAGIFRFRFWQCGQWVEVVIDDRLPVQGDKCLFVRPRHQNQEFWPCLLEKAYAKLLGSYSDLHYGFLEDALVDLTGGVITNIHLHSSPVDLVKAVKTATKAGSLITCATPSGPTDTAQAMENGLVSLHAYTVTGAEQIQYRRGWEEIISLWNPWGWGEAEWRGRWSDGSQEWEETCDPRKSQLHKKREDGEFWMSCQDFQQKFIAMFICSEIPITLDHGNTLHEGWSQIMFRKQVILGNTAGGPRNDAQFNFSVQEPMEGTNVVVCVTVAVTPSNLKAEDAKFPLDFQVILAGSQRFREKFPPVFFSSFRNTVQSSNNKFRRNFTMTYHLSPGNYVVVAQTRRKSAEFLLRIFLKMPDSDRHLSSHFNLRMKGSPSEHGSQQSIFNRYAQQRLDIDATQLQGLLNQELLTGPPGDMFSLDECRSLVALMELKVNGRLDQEEFARLWKRLVHYQHVFQKVQTSPGVLLSSDLWKAIENTDFLRGIFISRELLHLVTLRYSDSVGRVSFPSLVCFLMRLEAMAKTFRNLSKDGKGLYLTEMEWMSLVMYN

SEQ ID NO: 9561 - protein, 669 aa, Homo sapiens
MAYYQEPSVETSIIKFKDQDFTTLRDHCLSMGRTFKDETFPAADSSIGQKLLQEKRLSNVIWKRPQDLPGGPPHFILDDISRFDIQQGGAADCWFLAALGSLTQNPQYRQKILMVQSFSHQYAGIFRFRFWQCGQWVEVVIDDRLPVQGDKCLFVRPRHQNQEFWPCLLEKAYAKLLGSYSDLHYGFLEDALVDLTGGVITNIHLHSSPVDLVKAVKTATKAGSLITCATPSGPTDTAQAMENGLVSLHAYTVTGAEQIQYRRGWEEIISLWNPWGWGEAEWRGRWSDGSQEWEETCDPRKSQLHKKREDGEFWMSCQDFQQKFIAMFICSEIPITLDHGNTLHEGWSQIMFRKQVILGNTAGGPRNDAQFNFSVQEPMEGTNVVVCVTVAVTPSNLKAEDAKFPLDFQVILTSVQRFREKFPPVFFSSFRNTVQSSNNKFRRNFTMTYHLSPGNYVVVAQTRRKSAEFLLRIFLKMPDSDRHLSSHFNLRMKGSPSEHGSQQSIFNRYAQQRLDIDATQLQGLLNQELLTGPPGDMFSLDECRSLVALMELKVNGRLDQEEFARLWKRLVHYQHVFQKVQTSPGVLLSSDLWKAIENTDFLRGIFISRELLHLVTLRYSDSVGRVSFPSLVCFLMRLEAMAKTFRNLSKDGKGLYLTEMEWMSLVMYN

SEQ ID NO: 9562 - protein, 684 aa, Homo sapiens
MSLWPPFRCRWKLAPRYSRRASPQQPQQDFEALLAECLRNGCLFEDTSFPATLSSIGSGSLLQKLPPRLQWKRPPELHSNPQFYFAKAKRLDLCQGIVGDCWFLAALQALALHQDILSRVVPLNQSFTEKYAGIFRFWFWHYGNWVPVVIDDRLPVNEAGQLVFVSSTYKNLFWGALLEKAYAKLSGSYEDLQSGQVSEALVDFTGGVTMTINLAEAHGNLWDILIEATYNRTLIGCQTHSGEKILENGLVEGHAYTLTGIRKVTCKHRPEYLVKLRNPWGKVEWKGDWSDSSSKWELLSPKEKILLLRKDNDGEFWMTLQDFKTHFVLLVICKLTPGLLSQEAAQKWTYTMREGRWEKRSTAGGQRQLLQDTFWKNPQFLLSVWRPEEGRRSLRPCSVLVSLLQKPRHRCRKRKPLLAIGFYLYRMNKYHDDQRRLPPEFFQRNTPLSQPDRFLKEKEVSQELCLEPGTYLIVPCILEAHQKSEFVLRVFSRKHIFYEIGSNSGVVFSKEIEDQNERQDEFFTKFFEKHPEINAVQLQNLLNQMTWSSLGSRQPFFSLEACQGILALLDLNASGTMSIQEFRDLWKQLKLSQKVFHKQDRGSGYLNWEQLHAAMREAGIMLSDDVCQLMLIRYGGPRLQMDFVSFIHLMLRVENMEDVFQNLTQDGKGIYLQKPEWMMMALYS

SEQ ID NO: 9563 - protein, 684 aa, Homo sapiens
MSLWPPFRCRWKLAPRYSRRASPQQPQQDFEALLAECLRNGCLFEDTSFPATLSSIGSGSLLQKLPPRLQWKRPPELHSNPQFYFAKAKRLDLCQGIVGDCWFLAALQALALHQDILSRVVPLNQSFTEKYAGIFRFWFWHYGNWVPVVIDDRLPVNEAGQLVFVSSTYKNLFWGALLEKAYAKLSGSYEDLQSGQVSEALVDFTGGVTMTINLAEAHGNLWDILIEATYNRTLIGCQTHSGEKILENGLVEGHAYTLTGIRKVTCKHRPEYLVKLRNPWGKVEWKGDWSDSSSKWELLSPKEKILLLRKDNDGEFWMTLQDFKTHFVLLVICKLTPGLLSQEAAQKWTYTMREGRWEKRSTAGGQRQLLQDTFWKNPQFLLSVWRPEEGRRSLRPCSVLVSLLQKPRHRCRKRKPLLAIGFYLYRVAKYHDDQRRLPPEFFQRNTPLSQPDRFLKEKEVSQELCLEPGTYLIVPCILEAHQKSEFVLRVFSRKHIFYEIGSNSGVVFSKEIEDQNERQDEFFTKFFEKHPEINAVQLQNLLNQMTWSSLGSRQPFFSLEACQGILALLDLNASGTMSIQEFRDLWKQLKLSQKVFHKQDRGSGYLNWEQLHAAMREAGIMLSDDVCQLMLIRYGGPRLQMDFVSFIHLMLRVENMEDVFQNLTQDGKGIYLQKPEWMMMALYS

SEQ ID NO: 9564 - protein, 681 aa, Homo sapiens
MAAQAAGVSRQRAATQGLGSNQNALKYLGQDFKTLRQQCLDSGVLFKDPEFPACPSALGYKDLGPGSPQTQGIIWKRPTELCPSPQFIVGGATRTDICQGGLGDCWLLAAIASLTLNEELLYRVVPRDQDFQENYAGIFHFQFWQYGEWVEVVIDDRLPTKNGQLLFLHSEQGNEFWSALLEKAYAKLNGCYEALAGGSTVEGFEDFTGGISEFYDLKKPPANLYQIIRKALCAGSLLGCSIDVSSAAEAEAITSQKLVKSHAYSVTGVEEVNFQGHPEKLIRLRNPWGEVEWSGAWSDDASPVISPSAEGCRVKHTTMRSMSQMSLSDFVRQFSRLEICNLSPDSLSSEEVHKWNLVLFNGHWTRGSTAGGCQNYPATYWTNPQFKIRLDEVDEDQEESIGEPCCTVLLGLMQKNRRWRKRIGQGMLSIGYAVYQVLLCWYTLDVLGLNILASHCSTSFLLLEEASLLLYIPLPVALLRFRDSFLWLNTRRLRRICPQACHDALPFWQRPSSVPHPWMVSLEVFYRGGSFPHLQMIRFPLPFSRTDIKFDGFNINTCREMISLLDSNGTGTLGAVEFKTLWLKIQKYLEIYWETDYNHSGTIDAHEMRTALRKAGFTLNSQVQQTIALRYACSKLGINFDSFVACMIRLETLFKLFSLLDEDKDGMVQLSLAEWLCCVLV

SEQ ID NO: 9565 - protein, 381 aa, Homo sapiens
MAAQAAGVSRQRAATQGLGSNQNALKYLGQDFKTLRQQCLDSGVLFKDPEFPACPSALGYKDLGPGSPQTQGIIWKRPTELCPSPQFIVGGATRTDICQGGLGDCWLLAAIASLTLNEELLYRVVPRDQDFQENYAGIFHFQFWQYGEWVEVVIDDRLPTKNGQLLFLHSEQGNEFWSALLEKAYAKLNGCYEALAGGSTVEGFEDFTGGISEFYDLKKPPANLYQIIRKALCAGSLLGCSIDVSSAAEAEAITSQKLVKSHAYSVTGVEEVNFQGHPEKLIRLRNPWGEVEWSGAWSDDAPEWNHIDPRRKEELDKKVEDGEFWMSLSDFVRQFSRLEICNLSPDSLSSEEVHKWNLVLFNGHWTRGSTAGGCQNYPGSS

SEQ ID NO: 9566 - protein, 437 aa, Homo sapiens
MAAQAAGVSRQRAATQGLGSNQNALKYLGQDFKTLRQQCLDSGVLFKDPEFPACPSALGYKDLGPGSPQTQGIIWKRPTELCPSPQFIVGGATRTDICQGGLGDCWLLAAIASLTLNEELLYRVVPRDQDFQENYAGIFHFQFWQYGEWVEVVIDDRLPTKNGQLLFLHSEQGNEFWSALLEKAYAKLNGCYEALAGGSTVEGFEDFTGGISEFYDLKKPPANLYQIIRKALCAGSLLGCSIDVSSAAEAEAITSQKLVKSHAYSVTGVEEVNFQGHPEKLIRLRNPWGEVEWSGAWSDDAPEWNHIDPRRKEELDKKVEDGEFWMSLSDFVRQFSRLEICNLSPDSLSSEEVHKWNLVLFNGHWTRGSTAGGCQNYPATYWTNPQFKIRLDEVDEDQEESIGEPCCTVLLGLMQKNRRWRKRIGQGMLSIGYAVYQ

SEQ ID NO: 9567 - protein, 716 aa, Homo sapiens
MSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 9568 - protein, 690 aa, Homo sapiens
MRQTGGGATTDSASPVLNNVIKSQSYFTAKRVGLGNNSYLGVGRPSSQQWLSLPGPGGQGPKAKKSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKW

SEQ ID NO: 9569 - protein, 436 aa, Homo sapiens
MERLEIQRIEKEKWHRLEAKDLERRNEELEELYLLERCFPEAEKLKQETKLLSQWKHYIQCDGSPDPSVAQEMNTFISLWKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKW

SEQ ID NO: 9570 - protein, 722 aa, Homo sapiens
MGPKAKKSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 9571 - protein, 676 aa, Homo sapiens
MERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 9572 - protein, 485 aa, Homo sapiens
MGPKAKKSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWMLKVNIGELMASAMYPTNQKKDL

SEQ ID NO: 9573 - protein, 514 aa, Homo sapiens
MNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKW

SEQ ID NO: 9574 - protein, 92 aa, Homo sapiens
MERLEIQRIEKEKWHRLEAKDLERRNEELEELYLLERCFPEAEKLKQETKLLSQWKHYIQCDGSPDPSVAQEMNTFISLWKEKTNETFEEVI

SEQ ID NO: 9575 - protein, 657 aa, Homo sapiens
MDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 9576 - protein, 136 aa, Homo sapiens
MMHTTSYRRLSPPHLTDQPSAYSHTHRTFSHFSCGSQPAAQRLHVELWNADLQSEFLCPCLGLTLYLTCNPQLGKRKFCSHSSEDMSKMVSRRNVKDSHEVSGSLQATLQVISFSFPFLLHTCSHPLSHPTSGQRR

SEQ ID NO: 9577 - protein, 189 aa, Homo sapiens
MTDKTEKVAVDPETVFKRPRECDSPSYQKRQRMALLARKQGAGDSLIAGSAMSKEKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 9578 - protein, 288 aa, Homo sapiens
MSATGDRHPTQGDQEAPVSQEGAQAEAAGAGNQEGGDSGPDSSDVVPAAEVVGVAGPVEGLGEEEGEQAAGLAAVPRGGSAEEDSDIGPATEEEEEEEGNEAANFDLAVVARRYPASGIHFVLLDMVHSLLHRLSHNDHILIENRQLSRLMVGPHAAARNLWGNLPPLLLPQRLGAGAAARAGEGLGLIQEAASVPEPAVPADLAEMAREPAEEAAEEKLSEEATEEPDAEEPATEEPTAQEATAPEEVTKSQPEKWDEEAQDAAGEEEKEQEKEKDAENKVKNSKGT

SEQ ID NO: 9579 - protein, 288 aa, Homo sapiens; identical to SEQ ID NO: 9578

SEQ ID NO: 9580 - protein, 164 aa, Homo sapiens
MGDLPGLVRLSIALRIQPNDGPVFYKVDGQRFGQNRTIKLLTGSSYKVEVKIKPSTLQVENISIGGVLVPLELKSKEPDGDRVVYTGTYDTEGVTPTKSGERQPIQITMPFTDIGTFETVWQVKFYNYHKRDHCQWGSPFSVIEYECKPNETRSLMWVNKESFL

SEQ ID NO: 9581 - protein, 128 aa, Homo sapiens
MGDLPGLVRLSIALRIQPNDGPVFYKVDGQRFGQNRTIKLLTGSSYKVEVKIKPSTLQVENISIGGVLVPLELKSKEPDGDRVVYTGTYDTEGVTPTKSGERQPIQITMPECLEQRPQEISLTYECEE

SEQ ID NO: 9582 - protein, 92 aa, Homo sapiens
MNDYKLEEDPVTKERTFKRFAPRKGDKIYQEFKKLYFYSDAYRPLKFACETIIEEYEDEISSLIAQETHYLADKLCSEKSDLCETSANHTEL

SEQ ID NO: 9583 - protein, 1046 aa, Homo sapiens
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLETQTQLEHARIGELEQSLLLEKAQAERLLRELADNRLTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDRSSAPELLRLQHQLMSTEDALRDALDQAQQVEKLMEAMRSCPDKAQTIGNSGSANGIHQQDKAQKQEDKH

SEQ ID NO: 9584 - protein, 705 aa, Homo sapiens
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVRYVGPTDFASGIWLGLELRSAKGKNDGSVGDKRYFTCKPNHGVLVRPSRVTYRGINGSKLVDENC

SEQ ID NO: 9585 - protein, 723 aa, Homo sapiens
KMTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGIYGFFNQAFLVFFILVCLFEFLSNIYSNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVRYVGPTDFASGIWLGLELRSAKGKNDGSVGDKRYFTCKPNHGVLVRPSRVTYRGINGSKLVDENC

SEQ ID NO: 9586 - protein, 707 aa, Homo sapiens
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPVLGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVRYVGPTDFASGIWLGLELRSAKGKNDGSVGDKRYFTCKPNHGVLVRPSRVTYRGINGSKLVDENC

SEQ ID NO: 9587 - protein, 705 aa, Homo sapiens; identical to SEQ ID NO: 9584

SEQ ID NO: 9588 - protein, 214 aa, Homo sapiens
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPA

SEQ ID NO: 9589 - protein, 665 aa, Homo sapiens
MQRRKQKQKNLNESHYLCMLLQSELSEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVRYVGPTDFASGIWLGLELRSAKGKNDGSVGDKRYFTCKPNHGVLVRPSRVTYRGINGSKLVDENC

SEQ ID NO: 9590 - protein, 390 aa, Homo sapiens
MVTRAGAGTAVAGAVVVALLSAALALYGPPLDAVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGGISDLKLTIWGPEIETGVKTRAQGSCGPRTTTPTSPHLLLSPSPQVQPSPGGRVWRLLSHQAVQPPSLPEARSLHHHLRHDRRGGGRLQQAL

SEQ ID NO: 9591 - protein, 121 aa, Homo sapiens [sequence omitted]

SEQ ID NO: 9592 - protein, 237 aa, Homo sapiens
MLPDGPGSSLWGNPGLQTSDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 9593 - protein, 323 aa, Homo sapiens
MALGPRCGAIRACRRVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGACQIFNLSINWLPLRI

SEQ ID NO: 9594 - protein, 216 aa, Homo sapiens
MAVFPATARGQLGIRNAARWPWVLAVGQSGLADEGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 9595 - protein, 262 aa, Homo sapiens
MSRLSWGYREHNGPIHWKEFFPIADGDQQSPIEIKTKEVKYDSSLRPLSIKYDPSSAKIISNSGHSFNVDFDDTENKSVLRGGPLTGSYRLRQVHLHWGSADDHGSEHIVDGVSYAAELHVVHWNSDKYPSFVEAAHEPDGLAVLGVFLQIGEPNSQLQKITDTLDSIKEKGKQTRFTNFDLLSLLPPSWDYWTYPGSLTVPPLLESVTWIVLKQPINISSQQLAKFRSLLCTAEGEAAAFLVSNHRPPQPLKGRKVRASFH

SEQ ID NO: 9596 - protein, 436 aa, Homo sapiens
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAKSRRLERSTNSFSYSSYHTLEEIYSWIDNFVMEHSDIVSKIQIGNSFENQSILVLKFSTGGSRHPAIWIDTGIHSREWITHATGIWTANKIVSDYGKDRVLTDILNAMDIFIELVTNPDGFAFTHSMNRLWRKNKSIRPGIFCIGVDLNRNWKSGFGGNGSNSNPCSETYHGPSPQSEPEVAAIVNFITAHGNFKALISIHSYSQMLMYPYGRLLEPVSNQRELYDLAKDAVEALYKVHGIEYIFGSISTTLYVASGITVDWAYDSGIKYAFSFELRDTGQYGFLLPATQIIPTAQETWMALRTIMEHTLNHPY

SEQ ID NO: 9597 - protein, 436 aa, Homo sapiens; identical to SEQ ID NO: 9596

SEQ ID NO: 9598 - protein, 731 aa, Homo sapiens
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGQKRRQRG

SEQ ID NO: 9599 - protein, 589 aa, Homo sapiens
LEIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGQKRRQRG

SEQ ID NO: 9600 - protein, 487 aa, Homo sapiens
MSDLLSIYSAPVVVSTVLHITIVFPILQIRKLRLGRVHKLPRVLEVGNSGTMSRAYTFFFLRWNSMALTGYSWLLLSATFLNVGAEISITLEPAQPSEGDNVTLVVHGLSGELLAYSWYAGPTLSVSYLVASYIVSTGDETPGPAHTGREAVRPDGSLDIQGILPRHSGTYILQTFNRQLQTEVGYGHVQVHEILAQPTVLANSTALVERRDTLRLMCSSPSPTAEVRWFFNGGALPVALRLGLSPDGRVLARHGIRREEAGAYQCEVWNPVSVSRSEPINLTVYFGPERVAILQDSTTRTGCTIKVDFNTSLTLWCVSRSCPEPEYVWTFNGQALKNGQDHLNISSMTAAQEGTYTCIAKNTKTLLSGSASVVVKLSAAAVATMIVPVPTKPTEGQDVTLTVQGYPKDLLVYAWYRGPASEPNRLLSQLPSGTWIAGPAHTGREVGFPNCSLLVQKLNLTDTGRYTLKTVTVQGKTETLEVELQVA

SEQ ID NO: 9601 - protein, 425 aa, Homo sapiens
MALTGYSWLLLSATFLNVGAEISITLEPAQPSEGDNVTLVVHGLSGELLAYSWYAGPTLSVSYLVASYIVSTGDETPGPAHTGREAVRPDGSLDIQGILPRHSGTYILQTFNRQLQTEVGYGHVQVHEILAQPTVLANSTALVERRDTLRLMCSSPSPTAEVRWFFNGGALPVALRLGLSPDGRVLARHGIRREEAGAYQCEVWNPVSVSRSEPINLTVYFGPERVAILQDSTTRTGCTIKVDFNTSLTLWCVSRSCPEPEYVWTFNGQALKNGQDHLNISSMTAAQEGTYTCIAKNTKTLLSGSASVVVKLSAAAVATMIVPVPTKPTEGQDVTLTVQGYPKDLLVYAWYRGPASEPNRLLSQLPSGTWIAGPAHTGREVGFPNCSLLVQKLNLTDTGRYTLKTVTVQGKTETLEVELQVAPLG

SEQ ID NO: 9602 - protein, 363 aa, Homo sapiens
MDLSRPRWSLWRRVFLMASLLACGICQASGQIFITQTLGIKGYRTVVALDKVPEDVQEYSWYWGANDSAGNMIISHKPPSAQQPGPMYTGRERVNREGSLLIRPTALNDTGNYTVRVVAGNETQRATGWLEVLELGSNLGISVNASSLVENMDSVAADCLTNVTNITWYVNDVPTSSSDRMTISPDGKTLVILRVSRYDRTIQCMIESFPEIFQRSERISLTVAYGPDYVLLRSNPDDFNGIVTAEIGSQVEMECICYSFLDLKYHWIHNGSLLNFSDAKMNLSSLAWEQMGRYRCTVENPVTQLIMYMDVRIQAPHECPLPSGILPVVHRDFSISGSMVMFLIMLTVLGGVYICGVLIHALI

SEQ ID NO: 9603 - protein, 398 aa, Homo sapiens
MEVSGCPTPAGQSAPWGGKAALKAGRRDRQPLCQETQVLEGAEEVAVSLEGPLLLEDPRQLMDLSRPRWSLWRRVFLMASLLACGICQASGQIFITQTLGIKGYRTVVALDKVPEDVQEYSWYWGANDSAGNMIISHKPPSAQQPGPMYTGRERVNREGSLLIRPTALNDTGNYTVRVVAGNETQRATGWLEVLELGSNLGISVNASSLVENMDSVAADCLTNVTNITWYVNDVPTSSSDRMTISPDGKTLVILRVSRYDRTIQCMIESFPEIFQRSERISLTVAYGPDYVLLRSNPDDFNGIVTAEIGSQVEMECICYSFLDLKYHWIHNGSLLNFSDAKMNLSSLAWEQMGRYRCTVENPVTQLIMYMDVRIQAPHECSSSPPGSCFAHLPASMPC

SEQ ID NO: 9604 - protein, 234 aa, Homo sapiens
MEKCKGTSRMAGTTSADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 9605 - protein, 97 aa, Homo sapiens
MADKVLKEKRKLFIHSMGEGTINGLLDELLQTRVLNQEEMEKVKRENATVMDKTRALIDSVIPKGAQACQICITYICEEDSYLAETLGLSAGPIPGN

SEQ ID NO: 9606 - protein, 197 aa, Homo sapiens
MADKVLKEKRKLFIHSMGEGTINGLLDELLQTRVLNQEEMEKVKRENATVMDKTRALIDSVIPKGAQACQICITYICEEDSYLAETLGLSAALQAVQDNPAMPTCSSPEGRIKLCFLEDAQRIWKQKLQRCHVQNTIIKWSERYTSGSFEMQWLFLRTNFIERFWRNILLLPLHKGSLYPRIPGLGKELQTGTHKLS

SEQ ID NO: 9607 - protein, 97 aa, Homo sapiens; identical to SEQ ID NO: 9605

SEQ ID NO: 9608 - protein, 90 aa, Homo sapiens
MADQLLRKKRRIFIHSVGAGTINALLDCLLEDEVISQEDMNKVRDENDTVMDKARVLIDLVTGKGPKSCCKFIKHLCEEDPQLASKMGLH

SEQ ID NO: 9609 - protein, 223 aa, Homo sapiens
MALSVPLLYSLVRAISEAGAPPGSAGPLLLQPQRHRAAGCFLGTCLDLLDSFTLVELMLEGRVPLPAHLRYLLIAVYFLTLASPVLWLYELNAAAAAAASWGQASGPGSCSRLLRLLGGCLVDVPLLALRCLLVVSYQQPLSIFMLKNLFFLGCRGLEALEGCWDRGNRASPSRARGGYGAPPSAPPPPPPPPQGGSQLGHCISENEGGAHGYVNTLAVASQN

SEQ ID NO: 9610 - protein, 578 aa, Homo sapiens
MRPALGHPRSVSSASGSFPPPPAAARLQPLFLRGGSFRGRRGSGDSSTSTSTSRGGGGGRRGGGGGSPSSSTGAEREDDDESLSVSKPLVPNAALLGPPAQVGAPAGPAPVAFSSSAATSSSTSTPTSSCSMTAADFGGGAAAGAVGGPGSRSAGGAGGTGTGSGASCCPCCCCCGCPDRPGRRGRRRGCAPSPRCRWGYQALSVVLLLAQGGLLDLYLIAVTDLYWCSWIATDLVVVVGWAIFFAKNSRGRRGGAASGAHNHHLHHHHAAPPLHLPAPSAATAGAKARGARGGAGGAGGGLGAAAAAGEFAFAYLAWLIYSIAFTPKVVLILGTSILDLIELRAPFGTTGFRLTMALSVPLLYSLVRAISEAGAPPGSAGPLLLQPQRHRAAGCFLGTCLDLLDSFTLVELMLEGRVPLPAHLRYLLIAVYFLTLASPVLWLYELNAAAAAAASWGQASGPGSCSRLLRLLGGCLVDVPLLALRCLLVVSYQQPLSIFMLKNLFFLGCRGLEALEGCWDRGNRASPSRARGGYGAPPSAPPPPPPPPQGGSQLGHCISENEGGAHGYVNTLAVASQN

SEQ ID NO: 9611 - protein, 753 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQGTYIYFDYEKWGQRKKEGFTFEYRYLEDRDLQ

SEQ ID NO: 9612 - protein, 753 aa, Homo sapiens; identical to SEQ ID NO: 9611

SEQ ID NO: 9613 - protein, 753 aa, Homo sapiens; identical to SEQ ID NO: 9611

SEQ ID NO: 9614 - protein, 753 aa, Homo sapiens; identical to SEQ ID NO: 9611

SEQ ID NO: 9615 - protein, 753 aa, Homo sapiens; identical to SEQ ID NO: 9611

SEQ ID NO: 9616 - protein, 753 aa, Homo sapiens; identical to SEQ ID NO: 9611

SEQ ID NO: 9617 - protein, 753 aa, Homo sapiens; identical to SEQ ID NO: 9611

SEQ ID NO: 9618 - protein, 269 aa, Homo sapiens
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 9619 - protein, 294 aa, Homo sapiens
MERLTLTRTIGGPLLTATLLGKTTINDYQVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 9620 - protein, 458 aa, Homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 9621 - protein, 262 aa, Homo sapiens
MVAWRSAFLVCLAFSLATLVQRGSGDFDDFNLEDAVKETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 9622 - protein, 478 aa, Homo sapiens
MAAAAAGGAPGPAPGPAGPPPPAAPTSAARAPPQALRRRGDSRRRQAALFFLNNISLDGRPPSLGPGGEKPPPPPAEAREPPAPPPPEPPTGLPARTPAPQGLLSPTQVPTGLGLDGQRQRKRVTSQRCSLEFLEDAVGCAPAQRTKHTSGSPRHKGLKKTHFIKNMRQYDTRNSRIVLICAKRSLCAAFSVLPYGEGLRISDLRVDSQKQRHPSGGVSVSSEMVFELEGVELGADGKVVSYAKFLYPTNALVTHKSDSHGLLPTPRPSVPRTLPGSRHKPAPTKSAPASTELGSDVGDTLEYNPNLLDDPQWPCGKHKRVLIFASYMTTVIEYVKPSDLKKDMNETFREKFPHVKLTLSKIRSLKREMRSLSEECSLEPVTVAMAYVYFEKLVLQGKLSKQNRKLCAGACVLLAAKISSDLRKSGVTQLIDKLEERFRFNRRDLIGFEFTVLVALELALYLPENQVLPHYRRLTQQF

SEQ ID NO: 9623 - protein, 266 aa, Homo sapiens
DRAHLCQAVPVRGLLGPALWGRPADQVVSYAKFLYPTNALVTHKSDSHGLLPTPRPSVPRTLPGSRHKPAPTKSAPASTELGSDVGDTLEYNPNLLDDPQWPCGKHKRVLIFASYMTTVIEYVKPSDLKKDMNETFREKFPHVKLTLSKIRSLKREMRSLSEECSLEPVTVAMAYVYFEKLVLQGKLSKQNRKLCAGACVLLAAKISSDLRKSGVTQLIDKLEERFRFNRRDLIGFEFTVLVALELALYLPENQVLPHYRRLTQQF

SEQ ID NO: 9624 - protein, 258 aa, Homo sapiens
  MOD_RES (1)..(1): Any amino acid
XHQEQQDRAHLCQAVPVRGLLGPALWGRPADQVVSYAKFLYPTNALVTHKSDSHGLLPTPRPSVPRTLPGSRHKPAPTKSAPASTELGSDVGDTLEYNPNLLDDPQWPCGKHKRVLIFASYMTTVIEYVKPSDLKKDMNETFREKFPHVKLTLSKIRSLKREMRSLSEECSLEPVTVAMAYVYFEKLVLQGKLSKQNRKLCAGACVLLAAKISSDLRKSGVTQLIDKLEERFRFNRRDLIGFEFTVLVALELALYLPE

SEQ ID NO: 9625 - protein, 85 aa, Homo sapiens
MVGGEAAAAVEELVSGVRQAADFAEQFRSYSESEKQWKARMEFILRHLPDYRDPPDGSGRLDQLLSLSMVWANHLFLGCSPRGPK

SEQ ID NO: 9626 - protein, 116 aa, Homo sapiens
MVGGEAAAAVEELVSGVRQAADFAEQFRSYSESEKQWKARMEFILRHLPDYRDPPDGSGRLDQLLSLSMVWANHLFLGCSYNKDLLDKVMEMADGIEVEDLPQFTTRSELMKKHQS

SEQ ID NO: 9627 - protein, 123 aa, Homo sapiens
MSSGGSPGCLRLAEGCPNHRAWVRWNRRQPHSAFLIASHLFLSVLVWFNSFQGLELESENPRHLLWNVCLVVLVCPSSSLACRFQVYQRTFCSVESHRTKRKILQLFANILPYLYKQPYTKKH

SEQ ID NO: 9628 - protein, 131 aa, Homo sapiens
MGPAARPRRFVPGPPGDATTLELYTKVCLPRKRWRLPLGRLARSPRLQAPRVRAGSSHSCKEAAKYVFQTFHGSKLSASIKRSGVRGKSILGISMQMNGPGFQLRSGFPPLRAELAPSHARPEASGRCPGG

SEQ ID NO: 9629 - protein, 145 aa, Homo sapiens
MGLKSHVLPAPNSQGQGSLCIFVYVTSYMDYIQLQGKENLDCSGLNKQKIVFPHSMDSGDGWLMVLVQQLHEGRGHVLDPFALISVLVTSWSQDGCCIPKNHVCVQGRRGGGRGRAKLAGPVTFYQKVKPRQKSVSCSLPLHIFT

SEQ ID NO: 9630 - protein, 128 aa, Homo sapiens
MLQEALTEASFLKLVIFFFFFSFLRRSLALSPRLECSGAISAHCNLRLLGSSYSLASASRVSGITGSRHHAQLFFVFLVETGFHHIGQAGLELLTSGDPPTSASQSVGITGVSHRAQQMRIIFIFIKL

SEQ ID NO: 9631 - protein, 198 aa, Homo sapiens
MTLKEHAAFKHLFNKAHLAPPLIHLTLSGHSTCFREHRVGGKVIDQQHPKAEESFLVQNKMESPMSTFFYSRHGNNLISLSFPHISPFSIPQNRHCHHGLFSMSCWVRLPDGVAAGQRGSSLPRRGGRAEAPPTSRTGRRPGGGAPHFPDRVAAGRRGSSLLRRGGCWAEGLLTSQTGRPGRDAPHLPDGVAAGQRCS

SEQ ID NO: 9632 - protein, 149 aa, Homo sapiens
MQEIHEKVLNEVVGAMMYHTFSLTREDLENFKALRVIVQVGSGYDNVAIKAAGELEIAVCSIPSAAVEETADSTTGHILNLYWGNRSLYQALREGTRVQSVEQIGEVASVKARIRGEILGLIGFGRTQQEVAVRAKAFAGWDRAVPGCA

SEQ ID NO: 9633 - protein, 126 aa, Homo sapiens
MGLPAPSLHATSTLRPDQFSPHTNPSLSLPCLKSFPVSLWPWGRASLLCHLSRLFVCHRPLTPTSQAPNMFSCVSSSLTLAASSAWPASHLPISHSPFLPPHLLRSQLSVTSSREPRLSLPLQLGQ

SEQ ID NO: 9634 - protein, 515 aa, Homo sapiens
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSSGSRLGRVYHHDVRVAQHHVGTLRHKQAVCALKWSPDGRLLSSGCSDGLLTIWPHDPGASAQGQPLKVITQSTAVKAMDWCPWQSGVLAIGGGMKDGRLHILDINAGKSIQTPSTNSQICSLIWLPKTKEIATGQGTPKNDVTVWTCPTVSRSGHRGRVLHLSLSPDQTRVFSAAADGTASVWNCY

SEQ ID NO: 9635 - protein, 477 aa, Homo sapiens
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSSGSRLGRVYHHDVRVAQHHVGTLRHKQAVCALKWSPDGRLLSSGCSDGLLTIWPHDPGASAQGQPLKVITQSTAVKICSLIWLPKTKEIATGQGTPKNDVTVWTCPTVSRSGGFFGHRGRVLHLSLSPDQTRVFSAAADGTASVWNCY

SEQ ID NO: 9636 - protein, 192 aa, Homo sapiens
MEWKLERTAPRRVRTEEEMLWVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKDHFSGSMKKRFEQEDVGGKD

SEQ ID NO: 9637 - protein, 372 aa, Homo sapiens
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSRLEFSGVISAHCNLHLPSSWDYRRPPPCLVGQDWGVFIITMFG

SEQ ID NO: 9638 - protein, 519 aa, Homo sapiens
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSSGSRLGRVYHHDVRVAQHHVGTLRHKQAVCALKWSPDGRLLSSGCSDGLLTIWPHDPGASAQGQPLKVITQSTAVKAMDWCPWQSGVLAIGGGMKDGRLHILDINAGKSIQTPSTNSQICSLIWLPKTKEIATGQGTPKNDVTVWTCPTVSRSGGFFGHRGRVLHLSLSPDQTRVFSAAADGTASVWNCY

SEQ ID NO: 9639 - protein, 268 aa, Homo sapiens
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSGSMRNRWKPNSSKVLGRSPLTILQDDNSPGTLTLRQGKRPSPLSENVSELKEGAILGTGRLLKTGGRAWEQGQDHDKENQHFPLVES

SEQ ID NO: 9640 - protein, 332 aa, Homo sapiens
MAAVFLVTLYEYSPLFYIAVVFTCFIVTTGLVLGWFGWDVPVILRNSEETQFSTRVFKKQMRQVKNPFGLEITNPSSASITTGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 9641 - protein, 74 aa, Homo sapiens
MKFQECHSEVMRHGQKIYPSHHRIEMAVEIASLKCQHSSINQSPTRKNSNSTTGWLLWDLLMGIGNSGSNVVLT

SEQ ID NO: 9642 - protein, 249 aa, Homo sapiens
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQVGFLFTCIVGIEIGML

SEQ ID NO: 9643 - protein, 54 aa, Homo sapiens
MSLRRHIGNPEYLMKRIPQNPRYQHIKSRLDTGACVYLTSSPALPDCAMNGLCF

SEQ ID NO: 9644 - protein, 136 aa, Homo sapiens
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEA

SEQ ID NO: 9645 - protein, 465 aa, Homo sapiens
MRRAAGMEDFSAEEEESWYDQQDLEQDLHLAAELGKTLLERNKELEGSLQQMYSTNEEQVQEIEYLTKQLDTLRHVNEQHAKVYEQLDLTARDLELTNHRLVLESKAAQQKIHGLTETIERLQAQVEELQAQVEQLRGLEQLRVLREKRERRRTIHTFPCLKELCTSPRCKDAFRLHSSSLELGPRPLEQENERLQTLVGALRSQVSQERQRKERAEREYTAVLQEYSELERQLCEMEACRLRVQELEAELLELQQMKQAKTYLLGPDDHLAEALLAPLTQAPEADDPQPGRGDDLGAQDGVSSPAASPGHVVRKSCSDTALNAIVAKDPASRHAGNLTLHANSVRKRGMSILREVDEQYHALLEKYEELLSKCRQHGAGVRHAGVQTSRPISRDSSWRDLRGGEEGQGEVKAGEKSLSQHVEAVDKRLEQSQPEYKALFKEIFSRIQKTKADINATKVKTHSSK

SEQ ID NO: 9646 - protein, 184 aa, Homo sapiens
MWVFGYGSLIWKVDFPYQDKLVGYITNYSRRFWQGSTDHRGVPGKPGRVVTLVEDPAGCVWGVAYRLPVGKEEEVKAYLDFREKGGYRTTTVIFYPKDPTTKPFSVLLYIGTCDNPDYLGPAPLEDIAEQIFNAAGPSGRNTEYLFELANSIRNLVPEEADEHLFALEKLVKERLEGKQNLNCI

SEQ ID NO: 9647 - protein, 94 aa, Homo sapiens
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 9648 - protein, 242 aa, Homo sapiens
MWASRDHLPEPDLGDAAPPGSPSSFWTSGLPRQERSTSRQRSRGSPSSTCVPYKVHALATFECSATSHASRLWQTLQQFWADHISRPFSPRRPPLRRMPSLSTFYLLDHNTRQAELGLAYGAPCMRLSNQAFVFRGGRWTTESQLARTRSPLLSRTAWGWKAQVQRSKSQVLLEENNYLKLQQELLIDMLTETMARMHLLEKQRNPEVIPTAAARAGQRKMRKRAGASAGVLMIQPCALDSQ

SEQ ID NO: 9649 - protein, 78 aa, Homo sapiens
MSATTACWPAFTVLGEARGDQVDWSRLYRDTGLVKMSRKPRASSPFSNNHPSTPKRFPRQPKREKGPVKEVPGTKGSP

SEQ ID NO: 9650 - protein, 73 aa, Homo sapiens
MSATTACWPAFTVLGEARGDQVDWSRLYRDTGLVKMSRKPRASSPFSNNHPSTPKRRGRGKHPLIPGPEALSK

SEQ ID NO: 9651 - protein, 78 aa, Homo sapiens; identical to SEQ ID NO: 9649

SEQ ID NO: 9652 - protein, 110 aa, Homo sapiens
MWMGLIQLVEGVKRKDQGFLEKEFYHKTNIKMRCEFLACWPAFTVLGEAWRDQVDWSRLLRDAGLVKMSRKPRASSPLSNNHPPTPKRFPRQPGREKGPIKEVPGTKGSP

SEQ ID NO: 9653 - protein, 163 aa, Homo sapiens
MSKGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 9654 - protein, 138 aa, Homo sapiens
MSKGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDPPLPGLLFL

SEQ ID NO: 9655 - protein, 163 aa, Homo sapiens [sequence omitted]

SEQ ID NO: 9656 - protein, 165 aa, Homo sapiens
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 9657 - protein, 62 aa, Homo sapiens
MASNKTTLQKMGKKQNGKSKKVEEAEPEEFVVEKVLDRRVVNGKVEYFLKWKGFTDADNTWE

SEQ ID NO: 9658 - protein, 693 aa, Homo sapiens
MERAGATSRGGQAPGFLLRLHTEGRAEAARVQEQDLRQWGLTASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 9659 - protein, 616 aa, Homo sapiens
MSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 9660 - protein, 897 aa, Homo sapiens
MERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 9661 - protein, 1108 aa, Homo sapiens
MSSVKRPRGRPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEEQLLKDKRIQQKIKRFKLRQAQRAHFFADMEEEPFNPDYVEVDRVLEVSFCEDKDTGEPVIYYLVKWCSLPYEDSTWELKEDVDLAKIEEFEQLQASRPDTRRLDRPPSNIWKKIDQSRDYKNGNQLREYQLEGLNWLLFNWYNRRNCILADEMGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHLGLSAPVPRGR

SEQ ID NO: 9662 - protein, 2881 aa, Homo sapiens
MTDPMMDFFDDANLFGETLEGLSDDAFVQPGPVSLVDELNLGAEFEPLHIDSLNHVQGTPTHQKMTDFEQLNQFDSIKFHHVNQSFGSPAEHVLSPHSQFNCSPIHPQNQPNGLFPDVSDGSPMWGHQTATTISNQNGSPFHQQGHSHSMHQNKSFVAHHDFALFQANEQQTQCTSLRSQQNRNNLNPGQNSLSQSKNFMNVSGPHRVNVNHPPQMTNASNSQQSISMQQFSQTSNPSAHFHKCSSHQEGNFNGPSPNMTSCSVSNSQQFSSHYSFSSNHISPNSLLQSSAVLASNHTNQTLSDFTGSNSFSPHRGIKQESTQHILNPNTSLNSNNFQILHSSHPQGNYSNSKLSPVHMNFPDPVDSGTQMGHFNDHVETNGFSSLEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEEQLLKDKRIQQKIKRFKLRQAQRAHFFADMEEEPFNPDYVEVDRVLEVSFCEDKDTGEPVIYYLVKWCSLPYEDSTWELKEDVDLAKIEEFEQLQASRPDTRRLDRPPSNIWKKIDQSRDYKNGNQLREYQLEGLNWLLFNWYNRRNCILADEMGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHLGLSAPVPRGRKGKKVKTQTSSFDIQKAEWLRKYNPEQLLQDEGYKKHIKHHCNKVLLRVRMLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEELVDPNIFIQPITEERASRTLYRIELLRKVREQALRHPQLFERLKLCHPNPDLPVWWECGPHDRDLLIGAAKHGVSRTDYHILRDPELSFMAAQRNYSQSKMAHSRTSTPLLQQYQVALSASPLTSLPRLLDAKGIILEEMKVKSENLKEEPQSSEEESMSSVETRTLIKSEPVSPKNGVLPQATGDQKSGGKCETDRRMVAARTEPLTPNPASKKPRVHKRGSESSSDSDSDSERSSCSSRSSSSSSSSSCSHSRSGSSSSSSSSCSSASSSSSSSTSSSSSSSSSSSEESDSDEEEAQKRESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSDPSVPTPPGAGVKEEHDQSTQMSKEGGLKLTFQKQGLAQKRPFDGEDGALGQQQYLTRLRELQSASETSLVNFPKSIPVSGTSIQPTLGANGVILDNQPIVKKRRGRRKNVEGVDIFFFNRNKPPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKVGGAFAPPLKDLCRFLKENSEYGVAPEWGDVVKQSGFLPESMYERILTGPVVREEVSRRGRRPKSGIAKATAAAAAASATSVSGNPLLANGLLPGVDLTTLQALQQNLQNLQSLQVTAGLMGMPTGLPSGGEAKNMAAMFPMLLSGMAGLPNLLGMGGLLTKPTESGTEDKKGSDSKESEGKTERTESQSSENGGENSVSSSPSTSSTAALNTAAAANPLALNPLLLSNILYPGMLLTPGLNLHIPTLSQSNTFDVQNKNSDLGSSKSVEVKEEDSRIKDQEDKGGTEPSPLNENSTDEGSEKADASSGSDSTSSSSEDSDSSNED

SEQ ID NO: 9663 - protein, 2882 aa, Homo sapiens
MTDPMMDFFDDANLFGETLEGLSDDAFVQPGPVSLVDELNLGAEFEPLHIDSLNHVQGTPTHQKMTDFEQLNQFDSIKFHHVNQSFGSPAEHVLSPHSQFNCSPIHPQNQPNGLFPDVSDGSPMWGHQTATTISNQNGSPFHQQGHSHSMHQNKSFVAHHDFALFQANEQQTQCTSLRSQQNRNNLNPGQNSLSQSKNFMNVSGPHRVNVNHPPQMTNASNSQQSISMQQFSQTSNPSAHFHKCSSHQEGNFNGPSPNMTSCSVSNSQQFSSHYSFSSNHISPNSLLQSSAVLASNHTNQTLSDFTGSNSFSPHRGIKQESTQHILNPNTSLNSNNFQILHSSHPQGNYSNSKLSPVHMNFPDPVDSGTQMGHFNDHVETNGFSSLEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEEQLLKDKRIQQKIKRFKLRQAQRAHFFADMEEEPFNPDYVEVDRVLEVSFCEDKDTGEPVIYYLVKWCSLPYEDSTWELKEDVDLAKIEEFEQLQASRPDTRRLDRPPSNIWKKIDQSRDYKNGNQLREYQLEGLNWLLFNWYNRRNCILADEMGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHLGLSAPVPRGRKGKKVKTQTSSFDIQKAEWLRKYNPEQLLQDEGYKKHIKHHCNKVLLRVRMLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEELVDPNIFIQPITEERASRTLYRIELLRKVREQALRHPQLFERLKLCHPNPDLPVWWECGPHDRDLLIGAAKHGVSRTDYHILRDPELSFMAAQRNYSQSKMAHSRTSTPLLQQYQVALSASPLTSLPRLLDAKGIILEEMKVKSENLKEEPQSSEEESMSSVETRTLIKSEPVSPKNGVLPQATGDQKSGGKCETDRRMVAARTEPLTPNPASKKPRVHKRGSESSSDSDSDSERSSCSSRSSSSSSSSSCSHSRSGSSSSSSSSCSSASSSSSSSTSSSSSSSSSSSEESDSDEEEAQKRAESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSDPSVPTPPGAGVKEEHDQSTQMSKEGGLKLTFQKQGLAQKRPFDGEDGALGQQQYLTRLRELQSASETSLVNFPKSIPVSGTSIQPTLGANGVILDNQPIVKKRRGRRKNVEGVDIFFFNRNKPPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKVGGAFAPPLKDLCRFLKENSEYGVAPEWGDVVKQSGFLPESMYERILTGPVVREEVSRRGRRPKSGIAKATAAAAAASATSVSGNPLLANGLLPGVDLTTLQALQQNLQNLQSLQVTAGLMGMPTGLPSGGEAKNMAAMFPMLLSGMAGLPNLLGMGGLLTKPTESGTEDKKGSDSKESEGKTERTESQSSENGGENSVSSSPSTSSTAALNTAAAANPLALNPLLLSNILYPGMLLTPGLNLHIPTLSQSNTFDVQNKNSDLGSSKSVEVKEEDSRIKDQEDKGGTEPSPLNENSTDEGSEKADASSGSDSTSSSSEDSDSSNED

SEQ ID NO: 9664 - protein, 963 aa, Homo sapiens
MLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSDPSVPTPPGAGVKEEHDQSTQMSKVKKHVREKEFTVKIKDEGGLKLTFQKQGLAQKRPFDGEDGALGQQQYLTRLRELQSASETSLVNFPKSIPVSGTSIQPTLGANGVILDNQPIVKKRRGRRKNVEGVDIFFFNRNKPPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKVGGAFAPPLKDLCRFLKENSEYGVAPEWGDVVKQSGFLPESMYERILTGPVVREEVSRRGRRPKSGIAKATAAAAAASATSVSGNPLLANGLLPGVDLTTLQALQQNLQNLQSLQVTAGLMGMPTGLPSGGEAKNMAAMFPMLLSGMAGLPNLLGMGGLLTKPTESGTEDKKGSDSKESEGKTERTESQSSENGGENSVSSSPSTSSTAALNTAAAANPLALNPLLLSNILYPGMLLTPGLNLHIPTLSQSNTFDVQNKNSDLGSSKSVEVKEEDSRIKDQEDKGGTEPSPLNENSTDEGSEKADASSGSDSTSSSSEDSDSSNED

SEQ ID NO: 9665 - protein, 2881 aa, Homo sapiens; identical to SEQ ID NO: 9662

SEQ ID NO: 9666 - protein, 147 aa, Homo sapiens
MTAIRLREFIERRPVIPPSIFIAHQGRDVQGYYPGQLARLHFDHSAKRAPRPLIDLTIPPKTKYHYQPQLDQQTLIRYICLRRHSKPAEPWYKETTYRRDYSLPFYEIDWNQKLATVSLNPRPLNSLPELYCCEERSSFERNAFKLK

SEQ ID NO: 9667 - protein, 115 aa, Homo sapiens
MTAIRLREFIERRPVIPPSIFIAHQGRDVQGYYPGQLARLHFDHSAKRAPRHSKPAEPWYKETTYRRDYSLPFYEIDWNQKLATVSLNPRPLNSLPELYCCEERSSFERNAFKLK

SEQ ID NO: 9668 - protein, 183 aa, Homo sapiens
MEKRELKASVPKFDKIPWLSEASLVNKPLVLSLPRRYPHTSATFLTSSKKNMNLPILFQVPDVLSKARRNQCDSMLLRNQQLCSTCQEMKMVQPRTMKIPDDPKASFENCMSYRMSLHQPKFQTTPEPFHDDIPTESIHYRLPILGPRTAVFHGLLTEAYKTLKERQRSSLPRKEPIGKTTRQ

SEQ ID NO: 9669 - protein, 663 aa, Homo sapiens
MLQMPKLNEIPPGRAGRREARGEGRWPGQTGPEAARLEWRAQGQAGGARAPWDSWGSSRLPTQPGPGWSRCPPSLLCALSFQKSTMESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELRRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLRRSPDGAPVQVFVPEKGEIISQV

SEQ ID NO: 9670 - protein, 578 aa, Homo sapiens
MESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELRRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLRRSPDGAPVQVFVPEKGEIISQV

SEQ ID NO: 9671 - protein, 123 aa, Homo sapiens
MESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLC

SEQ ID NO: 9672 - protein, 40 aa, Homo sapiens
MESKDEVSDTDSGIILQSGPDSPVSPMKELTHAVHKQQRA

SEQ ID NO: 9673 - protein, 203 aa, Homo sapiens
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQDILLNVSFFLEE

SEQ ID NO: 9674 - protein, 302 aa, Homo sapiens
MERHMVRGQLYKHFDLERKNAKQAEARLDQRLQRLKVICLYHVKLLTWEQRQLQKELQRLQQAETMKKKFSSYLGNGFQKRPEDVLVFSPQGRQKHRAPQAKKMRALATRMAQDTCKSKSQVPPSHDAGLKDPMKSKKQPLSQNNRTACFIKEQPQAQEKDSVNPSKDVDPSKGISVPCQNQEVSTNTIEQGPSSSPASDSGMACADETRSKDVALKPDGNTGKQIPPKHMECAGSFEGEFTKPTFLELLSKARNAHYLRHRVPPESERLLSIGEIFGHGESSSSRAGKECENRVPSKFLPL

SEQ ID NO: 9675 - protein, 235 aa, Homo sapiens
MVRGQLYKHFDLERKNAKQAEARLDQRLQRLKVICLYHVKLLTWEQRQLQKELQRLQQETMKKKFSSYLGNGFQKRPEDVLVFSPQGRQKHRAPQAKKMRALATRMAQDTCKSKSQVPPSHDAGLKDPMKSKKQPLSQNNRTACFIKEQPQAQEKDSVNPSKDVDPSKGISVPCQNQEVSTNTIEQGPISSAQPLAFNGETILYSERNTRNLLPPTLSSMKQSNRGRQAISDRTD

SEQ ID NO: 9676 - protein, 261 aa, Homo sapiens
MENFSLLSISGPPISSSALSAFPDIMFSRATSLPDIAKTAVPTEASSPAQALPPQYQSIIVRQGIQNTALSPDCSLGDTQHGEKLRRNCTIYRPWFSPYSYFVCADKESQLEAYDFPEVQQDEGKWDNCLSEDMAENICSSSSSPENTCPREATKKSRHGLDSITSQDILMASRWHPAQQNGYKCVACCRMYPTLDFLKSHIKRGFREGFSCKVYYRKLKALWSKEQKARLGDRLSSGSCQAFNSPAEHLRQIGGEAYLCL

SEQ ID NO: 9677 - protein, 508 aa, Homo sapiens
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKREEERRKIEEEKEKKRENDIVFKAWLQKKREQVLEMRRIQRAKEIEDMNSRENRDPQQAFRLWLKKKHEEQMKERQTEELRKQEECLFFLKGTEGRERAFKQWLRRKRMEKMAEQQAVRERTRQLRLEAKRSKQLQHHLYMSEAKPFRFTDHYN

SEQ ID NO: 9678 - protein, 509 aa, Homo sapiens
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKREEERRKIEEEKEKKRENDIVFKAWLQKKREQVLEMRRIQRAKEIEDMNSRQENRDPQQAFRLWLKKKHEEQMKERQTEELRKQEECLFFLKGTEGRERAFKQWLRRKRMEKMAEQQAVRERTRQLRLEAKRSKQLQHHLYMSEAKPFRFTDHYN

SEQ ID NO: 9679 - protein, 356 aa, Homo sapiens
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKRE

SEQ ID NO: 9680 - protein, 508 aa, Homo sapiens; identical to SEQ ID NO: 9677

SEQ ID NO: 9681 - protein, 142 aa, Homo sapiens
MTVGARLRSKAESSLLRRGPRGRGRTEGDEEAAAILEHLEYADEAEAAAESGTSAADERGPGTRGARRVHFALLPERYEPLEEPAPSEQPRKRYRRKLKKYGKNVGKVIIKGCRYVVIGLQGFAAAYSAPFAVATSVVSFVR

SEQ ID NO: 9682 - protein, 110 aa, Homo sapiens
MEWGPGSDWSRGEAAGVDRGKAGLGLGGRPPPQPPREERAQQLLDAVEQRQRQLLDTIAACEEMLRQLGRRRPEPAGGGNVSAKPGAPPQPAVSARGGFPKDAGDGAAEP

SEQ ID NO: 9683 - protein, 47 aa, Homo sapiens
MLRQLGRRRPEPAGGGNVSAKPGAPPQPAVSARGGFPKDAGDGAAEP

SEQ ID NO: 9684 - protein, 159 aa, Homo sapiens
MGPGLRLVTGVRGGPSGREEGAWPRASAGPDRLSLALSRAGRLPAWTAGRRGWGSAGGHPHSRPGRSAPSSCWTRWSSGSGSSWTPSQPARRCYGSWAAGARSRLVAGTSQPNLERPPSRLSPPEAAFQRMLAMELRSPDHPRAEYPDFSPSPGPVAGL

SEQ ID NO: 9685 - protein, 47 aa, Homo sapiens; identical to SEQ ID NO: 9683

SEQ ID NO: 9686 - protein, 160 aa, Homo sapiens
MGKIALQLKATLENITNLRPVGEDFRWYLKMKCGNCGEISDKWQYIRLMDSVALKGGRGSASMVQKCKLCARENSIEILSSTIKPYNAEDNENFKTIVEFECRGLEPVDFQPQAGFAAEGVESGTAFSDINLQEKDWTDYDEKAQESVGIYEVTHQFVKC

SEQ ID NO: 9687 - protein, 137 aa, Homo sapiens
MGKIALQLKATLENITNLRPVGEDFRWYLKDSVALKGGRGSASMVQKCKLCARENSIEILSSTIKPYNAEDNENFKTIVEFECRGLEPVDFQPLGLLLKVWSQGQPSVTLICRRRTGLTMMKRPRSLWESMRSPTSL

SEQ ID NO: 9688 - protein, 207 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVEVYHTFHDEVDEYRRHWWRCNGPCQHRPPYYGYVKRATNREPSAHDYWWAEHQKTCGGTYIKIKEPENYSKKGKGKAKLGKEPVLAAENKGTFVYILLIFM

SEQ ID NO: 9689 - protein, 489 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVETLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKDKPNRGEAQLVIPFSGKGYVLGETSNLPSPGKLITSHAINKTQDLLNQNHSANAVRPNSKIKVKFEQNGSSKNSHLVSPAVSNSHQNVLSNYFPRVSFANQKAFRGVNGSPRISVTVGNIPKNSVSSSSQRRVSSSKISLRNSSKVTESASVMPSQDVSGSEDTFPNKRPRLEDKTVFDNFFIKKEQIKSSGNDPKYSTTTAQNSSSSSSQSKMVNCPVCQNEVLESQINEHLDWCLEGDSIKVKSEESL

SEQ ID NO: 9690 - protein, 187 aa, Homo sapiens
MKKTLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKDKPNRGEAQLVIPFSGKGYVLGETSNLPSPGKLITSHAINKTQDLLNQNHSA

SEQ ID NO: 9691 - protein, 250 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVETLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKGTFVYILLIFM

SEQ ID NO: 9692 - protein, 194 aa, Homo sapiens
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVEVYHTFHDEVDEYRRHWWRCNGPCQHRPPYYGYVKRATNREPSAHDYWWAEHQKTCGGTYIKIKEPENYKKRQRKGKTRKGTSIGRRE

SEQ ID NO: 9693 - protein, 823 aa, Homo sapiens
MWGSPALAWAVWLACVQPTVFPWSLSFRSDTDKPSSAAEVLTEASSCWTDTVECFSDYMTLWIPRSHVEGLRRWLARTLHLPGTWRSPDHLDSSLAKCGYFLHLASDGDFLFRVQYSACFVQKEKANYRLEIRIFQKGVMGLERSDRYIMKCPMLRSRLGQESVHCGPMFIQVSRPLPLWRDNRQTPWLLSLRGELVASLEDASLMGLYVDMNATTVTVQSPRQGLLQRWEVLNTSAELLPLWLVSGHHAYSLEAACPPVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQVWAAGPAAQEWLSRDLLHRPSDALAKKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 9694 - protein, 656 aa, Homo sapiens
MKCPMLRSRLGQESVHCGPMFIQVSRPLPLWRDNRQTPWLLSLRGELVASLEDASLMGLYVDMNATTVTVQSPRQGLLQRWEVSGGQQALPGVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQVWAAGPAAQEWLSRDLLHRPSDALAKKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 9695 - protein, 573 aa, Homo sapiens
MLTRNPKTKSSLQILQDSVKWHHMAHKVNSLLDAYSGLLSNESMILAVNSSFVDPLLQFESQLKIIESSFGMLVVMPSLDKVKEMGSSYEYIEDMENLYHNILNIYENILTSLVSKDLYKLQILKEMLVWMSKDSSYLQERIMVIINKVLRFTVTKVRKYISVDAPCLGLLAAELSLLCSHEDPSIVKQASLGMCHLLYIARCQNDIGTNKPTNGKSHSLQFPSSDVEFLPKEFQQDESKIAQRVGQTLLPPLLTDFVQSLLMKLSSPDDKIASDAASILIFTLEFHAEKVTMVSKIVDAIYRQLCDNNCMKDVMLQVITLLTCTSPKKVIFQLMDYPVPADDTLIQMWKAACSQASVAPHVLKTILLILKGKPGEMEDTVTEGKRFSLDITNLMPLAACQALCTFLPLGSYRKAVAQYFPQLLTTLMFQVFYNSELKPILKDRALYAQDALRVLLNCSGLQQVDITLMKENFWDQLSEDLCYYHGVCFIAKTLSEYNFPQFPETLSYLYKLSVEGPRRSEDTVIVLIFLTEVSFVDCEQLCSHFLFLPKFKSKFQFLVSLPLNVGSYQDLRS

SEQ ID NO: 9696 - protein, 861 aa, Homo sapiens
MLTRNPKTKSSLQILQDSVKWHHMAHKVNSLLDAYSGLLSNESMILAVNSSFVDPLLQFESQLKIIESSFGMLVVMPSLDKVKEMGSSYEYIEDMENLYHNILNIYENILTSLVSKDLYKLQILKEMLVWMSKDSSYLQERIMVIINKVLRFTVTKVRKYISVDAPCLGLLAAELSLLCSHEDPSIVKQASLGMCHLLYIARCQNDIGTNKPTNGKSHSLQFPSSDVEFLPKEFQQDESKIAQRVGQTLLPPLLTDFVQSLLMKLSSPDDKIASDAASILIFTLEFHAEKVTMVSKIVDAIYRQLCDNNCMKDVMLQVITLLTCTSPKKVIFQLMDYPVPADDTLIQMWKAACSQASVAPHVLKTILLILKGKPGEMEDTVTEGKRFSLDITNLMPLAACQALCTFLPLGSYRKAVAQYFPQLLTTLMFQVFYNSELKPILKDRALYAQDALRVLLNCSGLQQVDITLMKENFWDQLSEDLCYYHGVCFIAKTLSEYNFPQFPETLSYLYKLSVEGPRRSEDTVIVLIFLTELLNNFFKDPLPEEFLVLFINWINDSNPVVSRLILHRIVHMSPIINKTENVSSILIAILDAFLSKDDNVVLQALLTLRRLLNELDKVTYSLGTRIGSSYCTLMDHINGGIRSMAIRHFGQLVRDMRQYTWMVNDVVLEGLVPLILFLEDDDKRVAEACKYTLKICTSQLKWSTSRLLKDENYSFEMVVLNICNNLIISHRNYITDLTSDTLRFLWSPRTYLKRASVILIGYLAKSGGHLLLRDEIEVMLDVIERLLRDEDPMIKQLAEITYDIFKKKAHKLTSAPLKQNFQKLLKLFYIKKLKPLYNYNSPNGQIDSPTDSKDVKNDKAL

SEQ ID NO: 9697 - protein, 187 aa, Homo sapiens
  MOD_RES (1)..(1): Any amino acid
XMPLAACQALCTFLPLGSYRKAVAQYFPQLLTTLMFQVFYNSELKPILKDRALYAQDALRVLLNCSGLQQVDITLMKENFWDQLSEDLCYYHGVCFIAKTLSEYNFPQFPETLSYLYKLSVEGPRRSEDTVIVLIFLTELLNNFFKDPLPEEFLVLFINWINDSNPVVSRLILHRIVHMSPIINKVD

SEQ ID NO: 9698 - protein, 249 aa, Homo sapiens
MRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKQANPSVLERDVDTQEFNLEKARLEVHRFGITGYGKGKERILEQERAIMLGAKPPKKSYVNYKVLQEQIKEKKAAKEEEKRLAQETDIFKKKKRKGQEDR

SEQ ID NO: 9699 - protein, 263 aa, Homo sapiens
MSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 9700 - protein, 293 aa, Homo sapiens
MRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKQANPSVLERDVDTQEFNLEKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 9701 - protein, 292 aa, Homo sapiens
MRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKANPSVLERDVDTQEFNLEKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 9702 - protein, 256 aa, Homo sapiens
GSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 9703 - protein, 145 aa, Homo sapiens
  MOD_RES (1)..(1): Any amino acid
XRRGAGVRSGCASRACSGALGGRGPGESLFAQYPRRAEGRREKQQVTEQRNGWPSQSWSCCCSTCSPNKCSYILMTQCIGSREMELSAEWPGCSVNMKATKTARGSELILSLGSFSGRAGQRRRPPPGHQDGSDTRGLRRVQLAL

SEQ ID NO: 9704 - protein, 100 aa, Homo sapiens [sequence omitted]

SEQ ID NO: 9705 - protein, 357 aa, Homo sapiens
MRRTGPEEEACGVWLDAAALKRRKVQTHLIKPGTKMLTLLPGERKANIYFTQRRAPSTGIHQRSIASFFTLQPGKTNGSDQKSVSSHTESQINKESKKNATQLDHLIPGLAHDCMASPLATSTTADIQEAGLSPQSLQTSGHHRMKTPFSTELSLLQPDTPDCAGDSHTPLAFSFTEDLESSCLLDRKEEKGDSARKWEWLHESKKNYQSMEKHTKLPGDKCCQPLGKTKLERKVSAKENRQAPVLLQTYRESWNGENIESVKQSRSPVSVFSWDNEKNDKDSWSQLFTEDSQGQRVIAHNTRAPFQDVTNNWNWDLGPFPNSPWAQCQEDGPTQNLKPDLLFTQDSEGNQVIRHQF

SEQ ID NO: 9706 - protein, 371 aa, Homo sapiens
MRRTGPEEEACGVWLDAAALKRRKVQTHLIKPGTKMLTLLPGERKANIYFTQRRAPSTGIHQRSIASFFTLQPGKTNGSDQKSVSSHTESQINKESKKNATQLDHLIPGLAHDCMASPLATSTTADIQEAGLSPQSLQTSGHHRMKTPFSTELSLLQPDTPDCAGDSHTPLAFSFTEDLESSCLLDRKEEKGDSARKWEWLHESKKNYQSMEKHTKLPGDKCCQPLGKTKLERKVSAKENRQAPVLLQTYRESWNGENIESVKQSRSPVSVFSWDNEKNDKDSWSQLFTEDSQGQRVIAHNTRAPFQDVTNNWNWDLGPFPNSPWAQCQEDGPTQNLKPDLLFTQDSEVQALACQQDCCRRSILKRQKHLR

SEQ ID NO: 9707 - protein, 98 aa, Homo sapiens
MALKTSLGSVQFMEQFCWPHLRSFCETCVGSWSIQMRQHHHQSSFPGSLPQETNLTLKVCKPQAPQKLDPTLSSCFFIESCGAQVPVEGSRRETSITV

SEQ ID NO: 9708 - protein, 129 aa, Homo sapiens
MWLWQDIQCCPAPPSAPPRALEPGRAPPPPGEGLGAGIPSLSPPQKKPQSVGICVRQKGRQKAGLEKGNRKKELRQANCPSLRPQRKGADTRRLPRETRPTKKRTAAAQPFLQLWNPAPHTSNGRTGDL

SEQ ID NO: 9709 - protein, 80 aa, Homo sapiens
MAEKILEKLDVLDKQAEIILARRTKINRLQSEGRKTTMAIPLTFDFQLEFEEALATSASKAISKIKEDKSCSITKSKISE

SEQ ID NO: 9710 - protein, 80 aa, Homo sapiens
MAEKILEKLDVLDKQAEIILARRTKINRLQSEGRKTTMAIPLTFDFQLEFEEALATSASKAISKIKEDKSCSITKSKISN

SEQ ID NO: 9711 - protein, 281 aa, Homo sapiens
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTEPVEEHLKSRSIRPYLYLKDTTEMENAGPLNVLYSQHRQACRRSLGSTDFSPMFNIQSNAHKKEKDSTLFTAQIEKKPRKPLDSVGLLEGDRNKRKKSPQMNDFNIKENKSVRNYQLSKYRSVRKKSLLPLCFEDELKNPHAKIVNVSPTKTVTSHMEQKDTNPII

SEQ ID NO: 9712 - protein, 400 aa, Homo sapiens
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTAQIEKKPRKPLDSVGLLEGDRNKRKKSPQMNDFNIKENKSVRNYQLSKYRSVRKKSLLPLCFEDELKNPHAKIVNVSPTKTVTSHMEQKDTNPIIFHDTEYVRMLLLTKNRFSSHPLENENIYPHKRTNFILERNCEILKSIIGNQSISLFKPQKTMPTVQRKDIQIPMSFKAGHTTVDDKLKKKTNKQTLENRSWNTLYNFSQNFSSLTKQFVGYLDKAVIHEMSAQTGKFERMFSAGKPTSIPTSSALPVKCYSKPFKYIYELNNVTPLDNLLNLSNEILNAS

SEQ ID NO: 9713 - protein, 400 aa, Homo sapiens; identical to SEQ ID NO: 9712

SEQ ID NO: 9714 - protein, 281 aa, Homo sapiens; identical to SEQ ID NO: 9711

SEQ ID NO: 9715 - protein, 400 aa, Homo sapiens; identical to SEQ ID NO: 9712

SEQ ID NO: 9716 - protein, 158 aa, Homo sapiens
MRRSLRAGKRRQTAGKSKSPPKVPIVIQDDSLPAGPPPQIRILKRPTSNGVVSSPNSTSRPTLPVKSLAQREAEYAEARKRILGSASPEEEQEKPILDRPTRISQPEDSRLQTAQINAGKKRCRRCCRHRLLGRPPRVALPWQTAGLEQRERPDLLAL

SEQ ID NO: 9717 - protein, 152 aa, Homo sapiens
MEDEEVAESWEEAADSGEIDRRLEKKLKITQKESRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 9718 - protein, 133 aa, Homo sapiens
MRRSLRAGKRRQTAGRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 9719 - protein, 140 aa, Homo sapiens [sequence omitted]

SEQ ID NO: 9720 - protein, 159 aa, Homo sapiens
MSYEVATALENRSHKVRYSDSVENGSIIFSLSGVAFLLMDTKECLLSTEEIFLAKIEKFINIHQNSFLVLSAALHGPEEWKLMFRIQQRFLGCNLRILPVHNTVNAINLMCTIAKTTSKPYIDSICYRMITAKAYIIEQSPVWKTLQKIKLNSDSVNPN

SEQ ID NO: 9721 - protein, 180 aa, Homo sapiens
MAESGKEKIKWTTTIIISSSLKSYEVATALENRSHKVRYSDSVENGSIIFSLSGVAFLLMDTKECLLSTEEIFLAKIEKFINIHQNSFLVLSAALHGPEEWKLMFRIQQRFLGCNLRILPVHNTVNAINLMCTIAKTTSKPYIDSICYRMITAKAYIIEQSPVWKTLQKIKLNSDSVNPN

SEQ ID NO: 9722 - protein, 270 aa, Homo sapiens
MQGNNLQPPSPRPLECWSLHREAPQRTEASRTHPSPFLALPGSHRTANQAQVVPGLVHHPQENTQRLRIRAGLSPFPRARLAAIGSTHGHRWVPGICLPRCLCPASCALHACPPHCNNAEAHSWLRLGGPLQSRSVEHQQHACGWGWVTHATYGERGTSQAAERQRIAHTRALSVGNCPRSHFQCEFSSISKWSEGTGTFSPRPRAVKSGVGGQPSPHIRITWRSCTTLTSKPCSRAITPECVVGWSRRSRHWYSDMRTGECQGLSPITR

SEQ ID NO: 9723 - protein, 110 aa, Homo sapiens
MTYPPHRAFSRSDVPYPLLSSPVQWPLSLVVGDTSTRWPQQPSALESDCPGPSHPCLAGLLGPMHPVDIPLSTALHSKHQRRLTQCVLMVQSPSKQRSLYLLNKKIPHDA

SEQ ID NO: 9724 - protein, 135 aa, Homo sapiens
MGNYLLRKLSCLGENQKKPKKGNPDEERKRQEMTTFERKLQDQDKKSQEVSSTSNQENENGSGSEEVCYTVINHIPHQRSSLSSNDDGYENIDSLTRKVRQFRERSETEYALLRTSVSRPCSCTHEHDYEVVFPH

SEQ ID NO: 9725 - protein, 115 aa, Homo sapiens
MGNYLLRKLRQEMTTFERKLQDQDKKSQEVSSTSNQENENGSGSEEVCYTVINHIPHQRSSLSSNDDGYENIDSLTRKVRQFRERSETEYALLRTSVSRPCSCTHEHDYEVVFPH

SEQ ID NO: 9726 - protein, 133 aa, Homo sapiens
MVMLEDSNSSTGCGARNCVECLVFLSVLGCQSERKGQMRTQQAGRWLRAGREASSETNPEGTLILDFQSPELPLAARGWQEHEPVVRCNVLPHAFSSWCFGQNFPKWSETQELRNRVTVKRWEIISCENSGES

SEQ ID NO: 9727 - protein, 115 aa, Homo sapiens; identical to SEQ ID NO: 9725

SEQ ID NO: 9728 - protein, 80 aa, Homo sapiens
MGNYLLRKLSCLGENQKKPKKGNPDEERKRQEMTTFERKLQDQDKKSQEVSSTSNQENENGSGSEEVCYTVINHIPHQRS

SEQ ID NO: 9729 - protein, 115 aa, Homo sapiens; identical to SEQ ID NO: 9725

SEQ ID NO: 9730 - protein, 194 aa, Homo sapiens
MFLTAVNPQPLSTPSWQIETKYSTKVLTGNWMEERRKFTRDTDKTPQSIYRKEYIPFPDHRPDQISRWYGKRKVEGLPYKHLITHHQEPPHRYLISTYDDHYNRHGYNPGLPPLRTWNGQKLLWLPEKSDFPLLAPPTNYGLYEQLKQRQLTPKAGLKQSTYTSSYPRPPLCAMSWREHAVPVPPHRLHPFPHF

SEQ ID NO: 9731 - protein, 156 aa, Homo sapiens
MFLTAVNPQPLSTPSWQIETKYSTKVLTGNWMEERRKGLPYKHLITHHQEPPHRYLISTYDDHYNRHGYNPGLPPLRTWNGQKLLWLPEKSDFPLLAPPTNYGLYEQLKQRQLTPKAGLKQSTYTSSYPRPPLCAMSWREHAVPVPPHRLHPFPHF

SEQ ID NO: 9732 - protein, 1473 aa, Homo sapiens
MTRMSCPWGSYQWEPGACPAAPRGIGGGDMAGGIPDVRGLQEAALGAGRSQEEARLVEEAQTPVMLPQDSGQRVEEVPGDLMAKRMSLILHVQKLPWDHVPCLRRTRQNLYQDVGGHAHGSGLGGAKRGAARSALRRPLPPATCRPAGIVSGPSPRLDSNPTGAHLIKQTRPLTVEWTKDTPVPEPMELRSDASHKENVSPKPAALPKPGKRLKQRRFRRSLGIGLSGRHDQWVPGCQVERGGPAATPSPGAVLDQEPCRVQTNLASPGPRLGLALKDTTGQLVNSSFWQQSNLQSLARRRQGKAREFAIQQSNLSINETSSPHLCPEPGGSSGPHKLPWGPLLSQEPLARPSSCLRQSGLPAPGTPSGDFRPTEAFAPLDGHTQPGLRSWGGLGSWRSRLVGEPLTLEDLAVPSQNQTQAPSRAAVHQLLASVHCLAQEAARLRCQAPQEPPAWGVSPKQKGEEGAPRERVHREEERTAFHLSDTVPASSASKNKAQNITAPESEAICWQLLSRCFRSWRHLVKRQREPAAAAVALGRWQLLRKCLQALWLREAQLEAAWGQYTKVLLVRSFREVSGLQVGPGGRVKQCPGSLREEEIAQRLLSHPRQRTDSRHERVQILQALQLAVFFLWCQQKKRARQERETLRKATRATQRTGSFPQAWHSTAAGVAWVAPLSPQHQRAWLCRCFGAWQQFVQRGSRYRDHLADRRTGTLRKCLEQWVRMKQLRESDGAKVTQLSLCRQKAGREAVYTAGPGACGLGAVGQAQGQQEQGRGSLQDACWTLALCWALLLWKMRLFQRQWANSFFQGLQQRMLQRSLRWWHLRALGPDATSSCTKTPSALEPLSSSTLQDSLEKVPRAPTLPDTLQGSLLWAAGQRQQGQCLLLWQARAQQFQGTARWYQHTRQRRIFLSWSRWATAQWAWRELASHRAWDRTCRAVLGLWRQRLLQSRLVEWWAQERGWRLARDALCHWHSCWQGQQFLHEKCQTWVQVHLQGLQKVVFRSWQQAAAHQRCTVTRPEQLLLQSYFQAWCEVVRDTGVLRAQHQAFQDGLRRRALGAVFATWREAQEVAAGAQEQRVAQASLARWRSCGQQGQEDGQQKKARAPQAFPAWPVAPGMHHEAQQQAGESAGAQAAQCWTWCWALWVHESCRGQVSRAHASWKPRAWVLEASVQSAVRGGVQRAILTQLRPAELRRFLRTVQLRVRLGLPGAGKTRSCWTQATELVPPAPSLQCSLGGRRKPRGTAWAQRCREHSLCPAFQLWPQWPGQSSWVPGLPLWTRDQGPRAHSSPEPRACKAQSKAHKRRLRARSCRILEKQAQAHGSALLLALKGHDALGHQEEVPAAPVPRGTASRAAGFPAGQVPGSGMAALGGCPRGRAAGADPAQGVAPEMGLADVVAADPATASGSAVTAAGRWAFKKWHQRLAARSPRRGAASSPRPWSKPGPKGPESGQEAARAPRGWGLGAEHGAQLQL

SEQ ID NO: 9733 - protein, 243 aa, Homo sapiens
RSDASHKENVSPKPAALPKPEQRRFRRSLGIGLSGRHDQWVPGCQVERGGPAATPSPGAVLDQEPCRVQTNLASPGPRLGLALKDTTGQLVNSSFWQQSNLQSLARRRQGKAREFAIQQSNLSINETSSPHLCPEPGGSSGPHKLPWGPLLSQEPLARPSSCLRQSGLPAPGTPSGDFRPTEAFAPLDGHTQPGLRSWGGLGSWRSRLVGEPLTLEDLAVPSQNQTQAPSRAAVHQLLASTLG

SEQ ID NO: 9734 - protein, 728 aa, Homo sapiens
MEGEGVRNFKELRAKFQNLDAPPLPGPIKFPAGVSPKGDIGGTQSTQILANGKPLSSNHKQRTPYCSSSESQPLQPQKIKLAQKSEIPKCSNSPGPLGKSTVCSATSSQKASLLLEVTQSNVEIITKEKVMVANSFRNKLWNWEKVSSQKSEMSSALLLANYGSKAIHLEGQKGMGLTPEEPRKKLETKGAQTLPSQKHVVAPKILHNVSEDPSFVISQHIRKSWENPPPERSPASSPCQPIYECELASQAPEKQPDVRHHHLPKTKPLPSIDSLGPPPPKPSRPPIVNLQAFQRQPAAVPKTQGEVTVEEGSLSPERLFNAEFEEPHNYEATISYLRHSGNSINLCTAKEIADPTYEVGIEELQKPGKNFPYPEPSAKHEDKKMKEKQPCELKPKNTEKEPYSNHVFKVDACEGTPEKIQMTNVHTGRRNMLAGKQEAMIDIIQTNPCPEGPKLARHSQGHCGHLEVLESTKETPDLGVSKTSSISEEIYDDVEYSRKEVPKLNYSSSLASSSEENRELYEDVYKTKNNYPKIDLDGKEALKRLQQFFKKEKDRFKIKKTKSKENLSAFSILLPDLELKSQEVIIYDDVDLSEKESKDEDKLKMWKPKFLTPKEKKEKNGAEESESFSPRNFFKTKKQNLEKNRMKREEKLFRERFKYDKEIIVINTAVACSNNSRNGIFDLPISPGEELEVIDTTEQNLVICRNSKGKYGYVLIEHLDFKHQSWSP

SEQ ID NO: 9735 - protein, 696 aa, Homo sapiens
MPTQDGQLRRPARPPGPRAWMEPRGGGSSQFSSCPGPASSGDQMQRLLQGPAPRPPGEPPGSPKSPGHSTGSQRPPDSPGAPPRSPSRKKRRAVGAKGGGHTGASASAQTGSPLLPAASPETAKLMAKAGQEELGPGPAGAPEPGPRSPVQEDRPGPGLGLSTPVPVTEQGTDQIRTPRRAKLHTVSTTVWEALPDVSRAKSDMAVSTPASEPQPDRDMAVSTPASEPQSDRDMAVSTPASEPQPDTDMAVSTPASEPQPDRDMAVSIPASKPQSDTAVSTPASEPQSSVALSTPISKPQLDTDVAVSTPASKHGLDVALPTAGPVAKLEVASSPPVSEAVPRMTESSGLVSTPVPRADAAGLAWPPTRRAGPDVVEMEAVVSEPSAGAPGCCSGAPALGLTQVPRKKKVRFSVAGPSPNKPGSGQASARPSAPQTATGAHGGPGAWEAVAVGPRPHQPRILKHLPRPPPSAVTRVGPGSSFAVTLPEAYEFFFCDTIEENEEAEAAAAGQDPAGVQWPDMCEFFFPDVGAQRSRRRGSPEPLPRADPVPAPIPGDPVPISIPEVYEHFFFGEDRLEGVLGPAVPLPLQALEPPRSASEGAGPGTPLKPAVVERLHLALRRAGELRGPVPSFAFSQNDMCLVFVAFATWAVRTSDPHTPDAWKTALLANVGTISAIRYFRRQVGQGRRSHSPSPSS

SEQ ID NO: 9736 - protein, 398 aa, Homo sapiens
MPRPGHPRPASGPPRLGPWERPTELCLETYDKPPQPPPSRRTRRPDPKDPGHHGPESITFISGSAEPALESPTCCLLWRPWVWEWCRAAFCFRRCRDCLQRCGACVRGCSPCLSTEDSTEGTAEANWAKEHNGVPPSPDRAPPSRRDGQRLKSTMGSSFSYPDVKLKGIPVYPYPRATSPAPDADSCCKEPLADPPPMRHSLPSTFASSPRGSEEYYSFHESDLDLPEMGSGSMSSREIDVLIFKKLTELFSVHQIDELAKCTSDTVFLEKTSKISDLISSITQDYHLDEQDAEGRLVRGIIRISTRKSRARPQTSEGRSTRAAAPTAAAPDSGHETMVGSGLSQDELTVQISQETTADAIARKLRPYGAPGYPASHDSSFQGTDTDSSGAPLLQVYC

SEQ ID NO: 9737 - protein, 207 aa, Homo sapiens
MPRPGHPRPASGPPRLGPWERPTELCLETYDKPPQPPPSRRTRRPDPKDPGHHGPESITFISGSAEPALESPTCLLRTPLRGLLKPTGPRSTMECPPALIVHPPAGGMASGSSQPWAAASATPMLSSKASLCIPTRGPPPQPLMRTPAARSHWPIPHPCDTACPAPLPVVLVAPRSTILSMSRTWTCRRWAVAPCRAEKLMCSSSRS

SEQ ID NO: 9738 - protein, 1530 aa, Homo sapiens
MSHSHPAGLLAAYNSLMDKHLAGYFNNTRIRRHLLRSGLITRSGRILSEKEYKLNMMKRDHQKYIRECLAQAIFHKVLDMERYHQLEIKKKLETLARKERIQRFKGEHTRRSVENNMPILSPHPPVGPKSNRGHSVLVDEGHSSPLALTAPRPYTAPGNMQPPIRLQPLPSNPAVETVPKVTSRSRSKTSLLENEALFPIGGKKAVMKFRNSIGNSQRMNSYQLPNINSYMMPIPPPLPPTGKITRENRSETWRRRRFRPTTAPNGLEPLLTKDSRRIHKTSLHSNAAITMIYLGKNVHLSSDNPDFRDEIKVYQQHCGGENLCVYKGKLLEKETFQFISKRHHGFPFSLTFFLNGMQVNRLSSCCEYKHRKGSRLGGKRGYFGFVCVERSSPCYKCIIAMGLDKKPSLPKSRKEKSTEKGEELKKAEGKVRKEREYVIPKRNEIKENKTSVSAKFSAQEIKTGLKEVVTAVEEMTSKGKPGQEVLEDDQENTLKYEYEEDFEVDEEKQGEKSNEEGQADVQMNGIPQSPLDDKKDNLDPEKESETSSQKAPDARDNVKDENDGCSESELEEDKQDMKTASSTSSRSHPYSSDSEDESAVGDREAHTDSSTDESARRSSSQELSENDKPRKSHLPIEESLEIEIEDQEITKADVETKPMPIDESFENVLKEGTEKGTQEIAEGLSEKSGKHVSAEEKEKDKSKLWEESTAQVKDKKAGLPGLEEGGKDSLPLAYVLALGAPTMNFMVDETAAINSNKESQQLVQKTYTLEKKEAMEEDEAPQHRDADIVQGKGEAALWGEAGAVHEAPLRAWKPTAEQPELAEEFTEKREIPPGIERGAEGAAEAEGVRRLGEGGSDPIGQAAAKDAVGLSKDEAPEKQALMLTVLETDKAASEGEQGLEKAVLANEAAALNLEHLHEVAALREAATSEEGEAEGGVAVSDVGESEEEASIDLEDTGPMEDTASKREDGSEEAILGGEEPAKERKEVMRTETRLSPFTGEAEASRMQVSEGSPEEGSLAKEAFLCKEDVEGEEMVTEAEANREDDRKEILPKELDLARERRKAERPKTSLRKTDSEREEVTRANALKDEDAFKEEQKLKAEEGETETEVRAEEETKAPPNEMGSDAENEAPVEASELSDNPGLLGEDSLKETVVPIFEATPGFEKSLENITALRKEGGGERLSEARDTEHKDREELSSRENRALKEGHRQDGEGALAAPEAEPAGKVQAPEGLIPATGQAEELAAKDHDSCAGLEGRAEGQGGVDVVLRTQEAVAEEDPIMAEKFREEAVDEDPEEEEDKECTLETEAMQDRNSEGDGDMEGEGNTQKNEGMGGGRVVAVEVLHGGGETAETAAEEREVLAGSETAEEKTIANKASSFSDVAEEETWHQQDELVGKTAAAGKVVVEELARSGEEVPAAEEMTVTYTTEAGVGTPGALERKTSGLGQEQEEGSEGQEAATGSGDGRQETGAAEKFRLGLSREGERELSPESLQAMATLPVKPDFTETREKQQHMVQGESETADVSPNNVQV

SEQ ID NO: 9739 - protein, 533 aa, Homo sapiens
MLAKGKKAVMKFRNSIGNSQRMNSYQLPNINSYMMPIPPPLPPTGKITRENRSETWRRRRFRPTTAPNGLEPLLTKDSRRIHKTSLHSNAAITMIYLGKNVHLSSDNPDFRDEIKVYQQHCGGENLCVYKGKLLEKETFQFISKRHHGFPFSLTFFLNGMQVNRLSSCCEYKHRKGSRLGGKRGYFGFVCVERSSPCYKCIIAMGLDKKPSLPKSRKEKSTEKGEELKKAEGKVRKEREYVIPKRNEIKENKTSVSAKFSAQEIKTGLKEVVTAVEEMTSKGKPGQEVLEDDQENTLKYEYEEDFEVDEEKQGEKSNEEGQADVQMNGIPQSPLDDKKDNLDPEKESETSSQKAPDARDNVKDENDGCSESELEEDKQDMKTASSTSSRSHPYSSDSEDESAVGDREAHTDSSTDESARRSSSQELSENDKPRKSHLPIEESLEIEIEDQEITKADVETKPMPIDESFENVLKEGTEKGTQEIAEGLSEKSGKHVSAEEKEKDKSKLWEESTAQVKDKKAGLPGLEEGGKYGR

SEQ ID NO: 9740 - protein, 243 aa, Homo sapiens
MRSRKLTGAVRSSARLKARSCSAARLASAQEVAGSTSAKTACLTSSSHKATDTRTSKKFKCDKGHLVKSELQKLVPKNDSASLPKVTPETPCENEFAEGSALLPGSEAGVSVQQGAASLPLGGCRVVSDSRLAKTRDGLSVPKHSAGSGAEESNSSSTVQKQNEPGLQTEDVQKPPLQMDNSVFLDDDSNQPMPVSRFFGNVELMQDLPPASSSCPSMSRREFRKMHFRAKDDDDDDDDDAEM

SEQ ID NO: 9741 - protein, 414 aa, Homo sapiens
MRESQDAAGAHGWNRVGSTATKWFTGAPFGVQSHRFDISAVYPNWKKFSTFTEAPYSTRYSTQVSHIGPGTYSSKETCFSKKKLMKEVDTGWAKAQEATRLTQLPHFQYQAIMKEKRLKEQKLGPGSYNLKDFLEQLREKPCSTRGLLSSGEVRFRGLTGNYYPGPGNYGEKGNPYTKLEENAWNRSHSEGLMCRMSNKPHPRPYQGSGLGPGTYFFKSDLETYVARSVGTRGPYDTFSGDRSKPLPYGHYSMQKKKPRELMNFKSFVEELNSHHNKKHGVFSKLPRNPKTPTERIYWANLSQCPRTLATSGPSFWLPQEKKCKPVNQPPFLLTSKGSGAKACQMIMGSWNPVGVGRYLNTWLMETKDRRQRYRSLFLSGSKRYLSDLARDMLMQIRLFCWKGLEVINFGLSPM

SEQ ID NO: 9742 - protein, 418 aa, Homo sapiens
MRESQDAAGAHGWNRVGSTATKWFTGAPFGVQSHRFDISAVYPNWKKFSTFTEAPYSTRYSTQVSHIGPGTYSSKETCFSKKKLMKEVDTGWAKAQEATRLTQLPHFQYQAIMKEKRLKEQKLGPGSYNLKDFLEQLREKPCSTRGLLSSGEVRFRGLTGNYYPGPGNYGEKGNPYTKLEENAWNRSHSEGLMCRMSNKPHPRPYQGSGLGPGTYFFKSDLETYVARSVGTRGPYDTFSGDRSKPLPYGHYSMQKKKPRELMNFKSFVEELNSHHNKKHGVFSKLPRNPKTPTERIYWANLSQCPRTLATSGPSFWLPQEKKCKPVNQPPFLLTSKGSGAKACQMIMGSWNPVGVGRYLNTWLMETKDRRQRYRSLFLSGSKRYLSDLARDMLMQERITPFTKGKCPPTVDYNSDPTP

SEQ ID NO: 9743 - protein, 123 aa, Homo sapiens
MLGPNAQVTVVVAQPGPDHLDHLLLDTQHCQHSSCGSAACTQLTWVPCLGGSHKASIKMSAQAVVSTEAPWERPCFQAHLGCLQNSVLCSCRMEGFSLFLAMLWGGVGELPSDPRGHLQFLAT

SEQ ID NO: 9744 - protein, 123 aa, Homo sapiens; identical to SEQ ID NO: 9743

SEQ ID NO: 9745 - protein, 101 aa, Homo sapiens
MSVEKMTKVEESFQKAMGLKKTVDRWRNSHTHCLWQMALGQRRNPYATLRMQDTMVQELALAKKQLLMVRQAALHQLFEKEHQQYQQELNQMGKAFYVERF

SEQ ID NO: 9746 - protein, 177 aa, Homo sapiens
MATNYSANQYEKAFSSKYLQNWSPTKPTKESISSHEGYTQIIANDRGHLLPSVPRSKANPWGSFMGTWQMPLKIPPARVTLTSRTTAGAASLTKWIQKNPDLLKASNGLCPEILGKPHDPDSQKKLRKKSITKTVQQARSPTIIPSSPAANLNSPDELQSSHPSAGHTPGPQRPAKS

SEQ ID NO: 9747 - protein, 169 aa, Homo sapiens
MPPTRDPFQQPTLDNDDSYLGELRASKKLPYKNPTHLAQQQEPWSRLNSTPTITSMRRDAYYFDPEIPKDDLDFRLAALYNHHTGTFKNKSEILLNQKTTQDTYRTKIQFPGEFLTPPTPPITFLANIRHWINPKKESIHSIQGSIVSPHTAATNGGYSRKKDGGFFST

SEQ ID NO: 9748 - protein, 157 aa, Homo sapiens
MERSPSRRRRLEEAPKLPYKNPTHLAQQQEPWSRLNSTPTITSMRRDAYYFDPEIPKDDLDFRLAALYNHHTGTFKNKSEILLNQKTTQDTYRTKIQFPGEFLTPPTPPITFLANIRHWINPKKESIHSIQGSIVSPHTAATNGGYSRKKDGGFFST

SEQ ID NO: 9749 - protein, 126 aa, Homo sapiens
MPSSTLTCKPFDLKQRSSRRGPKSTASASPRSCLKPSCGKQVCLLLSVRRSQSLAHPGRDSTRVLSYQQTSSDAVSQYKHTGKVEELYGLRLSWLSQAQFLLAQDKTAYAVKSVVLPASNHKTKGQ

SEQ ID NO: 9750 - protein, 71 aa, Homo sapiens
MPSSTLTCKPFDLKQRSSRRGPKSTASASPRSWILSQNPKAQSSHEKTSGKPKFREVLQNTNQYSSKFSRS

SEQ ID NO: 9751 - protein, 93 aa, Homo sapiens
MTNTKDPKRAMESTLATSNSATGPVTFSHVFGQQCQLMQAAVQSLHTLNDQISHFIVTKSKALEEDKDPFLPTEKETLKSSMILMRHLLMDAQ

SEQ ID NO: 9752 - protein, 327 aa, Homo sapiens
MASMAAAIAASRSAVMSGNRPLDDRERKRFTYFSSLSPMARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 9753 - protein, 289 aa, Homo sapiens
MARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 9754 - protein, 197 aa, Homo sapiens
MEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 9755 - protein, 167 aa, Homo sapiens
MPSQSACPVLSTAPGTPCDLRKHLLNMVSEEKRSPQLSAKTWRRGLRLQKRRNALFLPEGDICVVGSTSGARALIPETSKLERSGTVIAYCNLELLASSDPPVWASQSTGMTGMSYRSQPQLGFKSTPPAHSSVFHHSVKAPKEDQAQEAASRPLTSQDGWNPNIKK

SEQ ID NO: 9756 - protein, 287 aa, Homo sapiens
MNALANIPDVPVKYRKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPATYKPELPGKQSFLYNEDKKWIPVL

SEQ ID NO: 9757 - protein, 334 aa, Homo sapiens
MDNSAQKNERTGKHPRRASEVQKGFTAAYPTQSSIPFKSQASVIPESEKKGFNSQAKRFPHKKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPATYKPELPGKQSFLYNEDKKWIPVL

SEQ ID NO: 9758 - protein, 169 aa, Homo sapiens
MCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPGGSKASDLAGHLPKSTQPT

SEQ ID NO: 9759 - protein, 334 aa, Homo sapiens; identical to SEQ ID NO: 9757

SEQ ID NO: 9760 - protein, 144 aa, Homo sapiens
  MOD_RES (1)..(1): Any amino acid
XFTAAYPTQSSIPFKSQASVIPESEKKGFNSQAKRFPHKKNDIPGPGFYNVIHQSPVSNSVSLSKKGTCMFPSMCARLDTIISKYPAANAYTIPSDFISKRDFSNSCSSMFQLPSFMKALKFETPAPNYYNVRTLPMLAKYRSN

SEQ ID NO: 9761 - protein, 383 aa, Homo sapiens
MDNSAQKNERTGKHPRRASEVQKGFTAAYPTQSSIPFKSQASVIPESEKKGFNSQAKRFPHKKNDIPGPGFYNVIHQSPVSNSVSLSKKGTCMFPSMCARLDTIISKYPAANAYTIPSDFISKRDFSNSCSSMFQLPSFMSKTQRGSFAFADKGPPPGHYDINESLVKQSPNTLMSCFKSKTNRGLKLTSTGPGPGYYNPSDCTKVPKKTLFPKNPILNFSAQPSPLPPKPAWPSYVQARASRKAVLPLQRGQEMDPGSVGMSHKVKENSSHQPTLPSVPRTFLRRRPIMSVAADNLGGGSTTLAWHPSRTAAIAFVLSWRHCSLETSPQPHRLQWLPEQKGGVDRAPWLLPHAPIQAAFRHDSLPQTEGTPEAQTSRRISPP

SEQ ID NO: 9762 - protein, 168 aa, Homo sapiens
CARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPGGSKASDLAGHLPKSTQPT

SEQ ID NO: 9763 - protein, 287 aa, Homo sapiens; identical to SEQ ID NO: 9756

SEQ ID NO: 9764 - protein, 235 aa, Homo sapiens
MGMLAPGPLQGRRPRKGHKGQEDAVAPGCKASGRGSRVTHLLGYPTQNVSRSLRRKYAPPPCGGPEDVALAPCTAAAACEAGPSPVYVKVKSAEPADCAEGPVQCKNGLLVSSPHCEEPCAHSCAHPGLPPHLVHKLPLSYLQTQDTDAASRRINAPLAAGWSWLRLWLVTLASGVDFPQVSAWMRALPSPDCPGLRTTGEQMQKLLLKENKVKTRKSKRRSGEGSHLTTSILEQ

SEQ ID NO: 9765 - protein, 121 aa, Homo sapiens
MGCASAKHVATVQNEEEAQKGKNYQNGDVFGDEYRIKPVEEVKYMKNGAEEEQKIAARNQENLEKSASSNVRLKTNKEVPGLVHQPRANMHISESQQEFFRMLDEKIEKGRDYCSEEEDIT

SEQ ID NO: 9766 - protein, 87 aa, Homo sapiens
TGNHHSTFCLHEFDYSRLLCILEKFLCDTEKSASSNVRLKTNKEVPGLVHQPRANMHISESQQEFFRMLDEKIEKGRDYCSEEEDIT

SEQ ID NO: 9767 - protein, 92 aa, Homo sapiens
MWPVFWTVVRTYAPYVTFPVAFVVGAVGYHLEWFIRGKDPQPVEEEKSISERREDRKLDELLGKDHTQVVSLKDKLEFAPKAVLNRNRPEKN

SEQ ID NO: 9768 - protein, 92 aa, Homo sapiens; identical to SEQ ID NO: 9767

SEQ ID NO: 9769 - protein, 92 aa, Homo sapiens; identical to SEQ ID NO: 9767

SEQ ID NO: 9770 - protein, 92 aa, Homo sapiens; identical to SEQ ID NO: 9767

SEQ ID NO: 9771 - protein, 92 aa, Homo sapiens; identical to SEQ ID NO: 9767

SEQ ID NO: 9772 - protein, 126 aa, Homo sapiens
MLAVPVRLKVGSRKPEWGTNRLTSCPAKDPLDRRLQNLRDRERVPEPQRSLRPGVQEDSREHGQVPEVSDPQVDLEFVDLQAKPRYRRLILKTQIPEASDSQAAQKPQAHRQIPETTEAGRETTSN

SEQ ID NO: 9773 - protein, 229 aa, Homo sapiens
MFAIQPGLAEGGQFLGDPPPGLCQPELQPDSNSNFMASAKDANENWHGMPGRVEPILRRSSSESPSDNQAFQAPGSPEEGVRSPPEGAEIPGAEPEKMGGAGTVCSPLEDNGYASSSLSIDSRSSSPEPACGTPRGPGPPDPLLPSVAQAVQHLQVQERYKEQEKEKHHVHLVMYRRLALLQWIRGLQHQLIDQQARLQESFDTILDNRKELIRCLQQRAAPSRPQDQA

SEQ ID NO: 9774 - protein, 199 aa, Homo sapiens
MFAIQPGLAEGGQFLGDPPPGLCQPELQPDSNSNFMASAKDANENWHGMPGRVEPILRRSSSESPSDNQAFQAPGSPLEDNGYASSSLSIDSRSSSPEPACGTPRGPGPPDPLLPSVAQAVQHLQVQERYKEQEKEKHHVHLVMYRRLALLQWIRGLQHQLIDQQARLQESFDTILDNRKELIRCLQQRAAPSRPQDQA

SEQ ID NO: 9775 - protein, 106 aa, Homo sapiens
MPDAQFHRIMASEKLSFIRVQENEYSLNSVRASGFQRVLNLLESSLLWLYLPTTENLLCSSPRLSGDPTGYADPPPQNHRRRQSRSTPRLPGPGQLLSSRTRTLEG

SEQ ID NO: 9776 - protein, 762 aa, Homo sapiens
MEDDGSLLPEDELLADALLLEDERDELEDPEFDIKCLLQEAEDDVDPGHSSSVKELDTDADKLKKKTAEDRTQAFHLRQNLSALDKMHEEQELFTEKMRGELRACRQRRDLIDKQQEAVAAEIATEEEAGNMAAVGRLQAVSRRLFAELENERDLQSRTEAVLKESENTMWHIEIQEGRLEAFRTADREEVEATGRRLQVRAAEQLCREQEALGKVERNRLLRIRKSLNTQKELGLRHQKLLEDARKNHKVAVRFLKASLGRIREQEKKEEMECHEYMRRRMDAVVALKGSISANRDTLRKFQAWDRAKAELAEQRVQAEKKAILAQGRDAFRHLVHQRRRQELEAQKRAFEEEQKLRKQEIISRILKEEAEEEKRKKQHPPTSARHRLTLRDKTWNYISDFCKKTTVPTNTYTLDYEAAAGPGPSRLLEVVSSELIQGDPGASSEEETLAEPEISGLWNEDYKPYQVPKEDVDRKPVGGTKMDKDILERTVERLRSRVVHKQVVWGREFQGRPFNSKPELLHFQDFDIGKVYKKKITLVNTTYTINYCKLVGVEEHLRDFIHVDFDPPGPLSAGMSCEVLVTFKPMINKDLEGNISFLAQTGEFSVPLKCSTKKCSLSLDKELIDFGSYVVGETTSRTITLTNVGGLGTTFKFLPASEPCEMDDSQSALKLSSLLTYEDKSLYDKAATSFSEQQLEGTESSQADMQSRKELEKLDKEQEEEQPAGEPGCQAKPGWAGGEGLRAAFQGAEGPRGGLESREFS

SEQ ID NO: 9777 - protein, 101 aa, Homo sapiens
MEDDGSLLPEDELLADALLLEDERDELEDPEFDIKCLLQEAEDDVDPGHSSSVKELDTDADKLKKKTAEDRTQAFHLRQNLSALDKMHEEQELFTEKMSVS

SEQ ID NO: 9778 - protein, 171 aa, Homo sapiens
MFENLNTALTPKLQASRSFPHLSKPVAPGSAPLGSGEPGGPGLWVGSSQHLKNLGKAMGAKVNDFLRRKEPSSLGSVGVTEINKTAGAQLASGTDAAPEAWLEDERSVLQETFPRLDPPPPITRKRTPRALKTTQDMLISSQPVLSSLEYGTEPSPGQAQDSAPTAQPDVP

SEQ ID NO: 9779 - protein, 315 aa, Homo sapiens
MLVLVAQAGGDTLKVTGHYVKCVFLLFVSHLLSEPLSRTVDHGMFENLNTALTPKLQASRSFPHLSKPVAPGSAPLGSGEPGGPGLWVGSSQHLKNLGKAMGAKVNDFLRRKEPSSLGSVGVTEINKTAGAQLASGTDAAPEAWLEDERSVLQETFPRLDPPPPITRKRTPRALKTTQDMLISSQPVLSSLEYGTEPSPGQAQDSAPTAQPDVPADASQPEATMEREERGKVLPNGEVSLSVPDLIHKDSQDESKLKMTECRRASSPSLIERNGFKLSLSPISLAESWEDGSPPPQARTSSLDNEGPHPDLLSFE

SEQ ID NO: 9780 - protein, 272 aa, Homo sapiens
MFENLNTALTPKLQASRSFPHLSKPVAPGSAPLGSGEPGGPGLWVGSSQHLKNLGKAMGAKVNDFLRRKEPSSLGSVGVTEINKTAGAQLASGTDAAPEAWLEDERSVLQETFPRLDPPPPITRKRTPRALKTTQDMLISSQPVLSSLEYGTEPSPGQAQDSAPTAQPDVPADASQPEATMEREERGKVLPNGEVSLSVPDLIHKDSQDESKLKMTECRRASSPSLIERNGFKLSLSPISLAESWEDGSPPPQARTSSLDNEGPHPDLLSFE

SEQ ID NO: 9781 - protein, 98 aa, Homo sapiens
MASINRTIEIMKKHGVSKQHLLEEINKKRESNCLVERSNQVSLLRVQKRHFPDAYQSFTDTTTKEPVPNSGRSSWIKLSLLAHMERKHFPPKNNAIFG

SEQ ID NO: 9782 - protein, 440 aa, Homo sapiens
MTSIKEQAAISRLLSFLQEWDNAGKVARSHILDKFIETNQGKTAPELEQEFSQGASLFLVRLTTSLRITYMTDSCLEKLLRSIGIFLSAVSSNRYLIEFLEVGGVLTLLEILGLEKIKEEAKKESVKLLQVIANSGRTYKELICESYGVRSIAEFLAKSKSEETQEEVQVLLDSLVHGNPKYQNQVYKGLIALLPCESPKAQQLSLQTLRTAQPIIGTTHPSIVDCVLKVLGTMHLEVQYEAIELIKDLVGYDVRQALLKGLVALLIPSVKEISKLQAKILSDPSVLQLTPSLPMFLQQAAAAKAIGVLARNDMSIAEELLYLRVVRGLMAAMGNTDHSNSQRLASLTLECFVQMFPLVAEHVRKCMGEELYQLFLSNAEDLYMKIDSIQADILAANTVNVTKALCLHGSSYSMNTLYGSRDSAQMAYLTHFEEDVESKE

SEQ ID NO: 9783 - protein, 440 aa, Homo sapiens; identical to SEQ ID NO: 9782

SEQ ID NO: 9784 - protein, 237 aa, Homo sapiens
MGLCTLQPLGPPRKSSTSCGTWTASGLPSLGHLPRRLRLAFDFLEPRARGQRGGSGGCQSTRAAERTRPPHPPNAVLLLQPEPSLTWAQGRGCRGHFRSLPAAASRSGSRTLRCASSDRSLREQKQRRAGPDPTPSPAPPPAGPRPSPGSLGPSAPAAPRTARGAYELQGGASQDGPGQAAVGATPTTGPGTGGEGALLGCGSGRTPPTSATWRRRLLPAEVPPGAAAANFPERERL

SEQ ID NO: 9785 - protein, 226 aa, Homo sapiens
MRAPPLLLLLAACAPPPCAAAAPTPPGWEPTPDAPWCPYKVLPEGPEAGGGRLCFRSPARGFRCQAPGCVLHAPAGRSLRASVLRNRSVLLQWRLAPAAARRVRAFALNCSWRGAYTRFPCERVLLGASCRDYLLPDVHDSVLYRLCLQPLPLRAGPAAAAPETPEPAECVEFTAEPAGMQDIVVAMTAVGGSICVMLVVICLLVAYITENLMRPALARPGLRRHP

SEQ ID NO: 9786 - protein, 263 aa, Homo sapiens
MFGSSRGGVRGGQDQFNWEDVKTDKQRENYLGNSLMAPVGRWQKGRDLTWYAKGRAPCAGPSREEELAAVREAEREALLAALGYKNVKKQPTGLSKEDFAEVCKREGGDPEEKGVDRLLGLGSASGSVGRVAMSREDKEAAKLGLSVFTHHRVESGGPGTSAASARRKPRAEDQTESSCESHRKSKKEKKKKKKRKHKKEKKKKDKEHRRPAEATSSPTSPERPRHHHHDSDSNSPCCKRRKRGHSGDRRSPSRRWHDRGSEA

SEQ ID NO: 9787 - protein, 514 aa, Homo sapiens
MEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSEVLAWEGPFPLSMEILERLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVKAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 9788 - protein, 643 aa, Homo sapiens
MEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSEVLAWEGPFPLSMEILEVPEGRPIFLSPWVGSLQKGQRLCVYGLASPPWRVLASSKGRKVPRHFLVSGGYQGKLRRRPREFPTAYDLLGAFQPGRPLRVVATKDCEGEREENPEFTSLAVGDRLEVLGPGQAHGAQGSDVDVLVCQRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVKAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 9789 - protein, 260 aa, Homo sapiens
MEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHIFSSLRIAATRSAAQTQGEDLARVHQGWLQYVQQDSCPQEGPQAR

SEQ ID NO: 9790 - protein, 123 aa, Homo sapiens
MEPVPLQDFVRALDPASLPRVLRVCSGVYFEGSIYEISGNECCLSTGDLIKVTQVRLQKVVCENPKTSQTMELAPNFQVFSSLRIAATRSAAQTQGEDLARVHQGWLQYVQQDSCPQEGPQAR

SEQ ID NO: 9791 - protein, 133 aa, Homo sapiens
MEPVPLQDFVRALDPASLPRVLRVCSGVYFEGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQ

SEQ ID NO: 9792 - protein, 247 aa, Homo sapiens
MEPVPLQDFVRALDPASLPRVLRVCSGVYFEGSIYEISGNECCLSTGDLIKVTQVRLQKVVCENPKTSQTMELAPNFQVRRTIVKIPSTLEVDVEDVTASSRHVHFIKPLLLSEVLAWEGPFPLSMEILEVPEGRPIFLSPWVGSLQKGQRLCVYGLASPPWRVLASSKGRKVPRHFLVSGGYQGKLRRRPREFPTAYDLLGAFQPGRPLRVVATKDCEGEREENPEFTSLAVGDRLEVLGPGQAHG

SEQ ID NO: 9793 - protein, 391 aa, Homo sapiens
  MOD_RES (1)..(1): Any amino acid
XTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSERLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVKAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 9794 - protein, 199 aa, Homo sapiens
MEDAAAPGRTEGVLERQGAPPAAGQGGALVELTPTPGGLALVSPYHTHRAGDPLDLVALAEQVQKADEFIRANATNKLTVIAEQIQHLQEQARKVLEDAHRDANLHHVACNIVKKPGNIYYLYKRESGQQYFSIISPKEWGTSCPHDFLGAYKLQHDLSWTPYEDIEKQDAKISMMDTLLSQSVALPPCTEPNFQGLTH

SEQ ID NO: 9795 - protein, 111 aa, Homo sapiens
  MOD_RES (1)..(1): Any amino acid
XSALLLGVDGLLSGILAIIYVSAASFHLCFYSPGVPSTYKGLPCPYASCILASTSLLTKGNRFILCCMASLMILFMMDQSYYPYDKILESENWKKLVYIGGQFRFIIGWNF

SEQ ID NO: 9796 - protein, 229 aa, Homo sapiens
KGTSFFLSHDQSHSQINEVSWKDVTSALSLANMVLGLFSIIFSFSRKCHYASRMLLVSFLLDMAVRAMTSHINICSKLGAELNDFAVFTTFGLASALLLGVDGLLSGILAIIYVSAASFHLCFYSPGVPSTYKGLPCPYASCILASTSLLTKGNRFILCCMASLMILFMMDQSYYPYDKILESENWKKLVYIGGVIMLFFSPLSLSAFYCLMWSLSYIFFPDALWGKAA

SEQ ID NO: 9797 - protein, 232 aa, Homo sapiens
  MOD_RES (1)..(1): Any amino acid
XFFLSHDQSHSQINEVSWKDVTSALSLANMVLGLFSIIFSFSRKCHYASRMLLVSFLLDMAVRAMTSHINICSKLGAELNDFAVFTTFGLASALLLGVDGLLSGILAIIYVSAASFHLCFYSPGVPSTYKGLPCPYASCILASTSLLTKGNRFILCCMASLMILFMMDQSYYPYDKILESENWKKLVYIGGVIMLFFSPLSLSAFYCLMWSLSYIFFPDALWGKAACLSPQH

SEQ ID NO: 9798 - protein, 385 aa, Homo sapiens
MDSPSSVSSYSSYSLSSSFPTSPVNSDFGFPSDSEREDKGAHGPRPDTVGQRGGSRPSPGPIRCRHRSKVSGNQHTPSHPKQRGSASPMAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPMKLSGEGPRCYSLPVTLPSDWSYTLSPPSLPTLARKMTIGHREQQRSHPPVAADAHLLNL

SEQ ID NO: 9799 - protein, 385 aa, Homo sapiens; identical to SEQ ID NO: 9798

SEQ ID NO: 9800 - protein, 385 aa, Homo sapiens; identical to SEQ ID NO: 9798

SEQ ID NO: 9801 - protein, 167 aa, Homo sapiens
MAAEEKDPLSYFAAYGSSSSGSSDEEDNIEPEETSRRTPDPAKSAGGCRNKAEKRLPGPDELFRSVTRPAFLYNPLNKQIDWERHVVKAPEEPPKEFKIWKSNYVPPPETYTTEKKPPPPELDMAIKWSNIYEDNGDDAPQNAKKARLLPEGEETLESALEDLEIQN

SEQ ID NO: 9802 - protein, 182 aa, Homo sapiens
MAAEEKDPLSYFAAYGSSSSGSSDEEDNIEPEETSRRTPDPAKSAGGCRNKAEKRLPGPDELFRSVTRPAFLYNPLNKQIDWERHVVKAPEEPPKEFKIWKSNYVPPPETYTTEKKPPPPELDMAIKWSNIYEDNGDDAPQNAKKARLLPEGEETLESDDEKDEHTSKKRKVEPGEPAKKKK

SEQ ID NO: 9803 - protein, 145 aa, Homo sapiens
MAARQIWARTGAALCRQPSAAPPPAPLWVRAGFRQQLSLTLCPANEGNCGGSAPSTPGRPERAARPSVSEELTAAERQIAELHAAACAAGQLNYVDPATGYVVLTQIAHLQRGECCGSACRHCPYGQVNVKDPSKKKQFNSYFYV

SEQ ID NO: 9804 - protein, 131 aa, Homo sapiens
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPSPDLNDAVSSLRSPIPLLLSCAFVQVGMYFM

SEQ ID NO: 9805 - protein, 451 aa, Homo sapiens
MAEAAALVWIRGPGFGCKAVRCASGRCTVRDFIHRHCQDQNVPVENFFVKCNGALINTSDTVQHGAVYSLEPRLCGGKGGFGSMLRALGAQIEKTTNREACRDLSGRRLRDVNHEKAMAEWVKQQAEREAEKEQKRLERLQRKLVEPKHCFTSPDYQQQCHEMAERLEDSVLKGMQAASSKMVSAEISENRKRQWPTKSQTDRGASAGKRRCFWLGMEGLETAEGSNSESSDDDSEEAPSTSGMGFHAPKIGSNGVEMAAKFPSGSQRARVVNTDHGSPEQLQIPVTDSGRHILEDSCAELGESKEHMESRMVTETEETQEKKAESKEPIEEEPTGAGLNKDKETEERTDGERVAEVAPEERENVAVAKLQESQPGNAVIDKETIDLLAFTSVAELELLGLEKLKCELMALGLKCGGTLQERAARLFSVRGLAKEQIDPALFAKPLKGKKK

SEQ ID NO: 9806 - protein, 356 aa, Homo sapiens
MEHSLTPVTQCSMELFIVWNPDFAVEKEVLDLCSEHLVLRLRRQPIEKLVEPKHCFTSPDYQQQCHEMAERLEDSVLKGMQAASSKMVSAEISENRKRQWPTKSQTDRGASAGKRRCFWLGMEGLETAEGSNSESSDDDSEEAPSTSGMGFHAPKIGSNGVEMAAKFPSGSQRARVVNTDHGSPEQLQIPVTDSGRHILEDSCAELGESKEHMESRMVTETEETQEKKAESKEPIEEEPTGAGLNKDKETEERTDGERVAEVAPEERENVAVAKLQESQPGNAVIDKETIDLLAFTSVAELELLGLEKLKCELMALGLKCGGTLQERAARLFSVRGLAKEQIDPALFAKPLKGKKK

SEQ ID NO: 9807 - protein, 439 aa, Homo sapiens
MAEAAALVWIRGPGFGCKAVRCASGRCTVRDFIHRHCQDQNVPVENFFVKCHGAVYSLEPRLCGGKGGFGSMLRALGAQIEKTTNREACRDLSGRRLRDVNHEKAMAEWVKQQAEREAEKEQKRLERLQRKLVEPKHCFTSPDYQQQCHEMAERLEDSVLKGMQAASSKMVSAEISENRKRQWPTKSQTDRGASAGKRRCFWLGMEGLETAEGSNSESSDDDSEEAPSTSGMGFHAPKIGSNGVEMAAKFPSGSQRARVVNTDHGSPEQLQIPVTDSGRHILEDSCAELGESKEHMESRMVTETEETQEKKAESKEPIEEEPTGAGLNKDKETEERTDGERVAEVAPEERENVAVAKLQESQPGNAVIDKETIDLLAFTSVAELELLGLEKLKCELMALGLKCGGTLQERAARLFSVRGLAKEQIDPALFAKPLKGKKK

SEQ ID NO: 9808 - protein, 290 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPELSEKVTEDGTRNPNEKPTQQRSIAFSSNNSVAKPIQKSAKAATEEASSRSPKIDQKKSPYGLWIPI

SEQ ID NO: 9809 - protein, 291 aa, Homo sapiens
MWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIDIDEENLLVIDTWAKASELSEKVTEDGTRNPNEKPTQQRSIAFSSNNSVAKPIQKSAKAATEEASSRSPKIDQKKSPYGLWIPI

SEQ ID NO: 9810 - protein, 226 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPEKS

SEQ ID NO: 9811 - protein, 174 aa, Homo sapiens
MSNYVNDMWPGSPQEKDSPSTSRSGGSSRLSSRSRSRSFSRSSRSHSRVSSRFSSRSRRSKSRSRSRRRHQRKYRRTVYPEEHSRWRDRSRTRSRSRTPFRLSEKDRMELLEIAKTNAAKALGTTNIDLPASLRTVPSAKETSRGIGVSSNGAKPEVSILGLSEQNFQKANCQI

SEQ ID NO: 9812 - protein, 169 aa, Homo sapiens
MAPSEDPRDWRANLKGTIRETGLETSSGGKLAGHQKTVPTAHLTFVIDCTHGKQLSLAATASPPQAPSPNRGLVTPPMKTYIVFCGENWPHLTRVTPMGGGCLAQARATLPLCRGSVASASFPVSPLCPQEVPEAKGKPVKAAPVRSSTWGTVKDSLKALSSCVCGQAD

SEQ ID NO: 9813 - protein, 623 aa, Homo sapiens
MAGFSHFSQPPYRDLWEPPRPGGERESTQRLGGQRSGADSTACSRAGTPGAESEAGACWLHPHCSFTPRPRRRGCSDSLRGSRSLSDVARRPLERSRKHRPRSRRLEDAWGETGTKPRPAWQPQTQLPPQRPQPCPHYPLAQGDSPPPCPGGAGTPLSGTFRVEKAQGGDQWAVPLGRHLGRWSPSSVPSERSSVPSQKFKRHSACVCAQKRDSSDQVESLASRDSQPLASSKEMRSPHTQVLKSKLEEVVVSSQDQQIVALVLTRLKKAQRIRELQQQAAKAWEELKRSDQKVQMTLERERRLLLRQSQEQWQEKEQRKTLQSPEQRGLRRDSQRKNVPPGESRWKEQPEDQESPRQEKLEKARAQAEHRKQCQVRRLREQEKMLRNLREQHSLQLQRRLVEACRKRHLHAVEGQKKVQDTNLSSLINYQARKVLMDCQAKAEELLRQLSLEQSFQRSQEIHQGLRKERQRELREKAQKEEEQLQQARWRAGESEEQRKMRKRILVELADEKIRQARSHVHKTTRDKVQHLRELNHLREKNHHILKLKAEKEEKCHIEGIKEAIKKKEQRVQHISQGKDPNFQEFQKLPQASRREERAPPNSSLDQMVLEAQLRACQQNRGY

SEQ ID NO: 9814 - protein, 250 aa, Homo sapiens
MCDQQKQPQFPPSCVKGSGLGAGQGSNGASVKCPVPCQTQTVCVTGPAPCPTQTYVKYQVPCQTQTYVKCPAPCQRTYVKYPTPCQTYVKCPAPCQTTYVKCPTPCQTYVKCPAPCQMTYIKSPAPCQTQTCYVQGASPCQSYYVQAPASGSTSQYCVTDPCSAPCSTSYCCLAPRTFGVSPLRRWIQRPQNCNTGSSGCCENSGSSGCCGSGGCGCSCGCGSSGCCCLGIIPMRSRGPACCDHEDDCCC

SEQ ID NO: 9815 - protein, 250 aa, Homo sapiens; identical to SEQ ID NO: 9814

SEQ ID NO: 9816 - protein, 269 aa, Homo sapiens
MLLLDLMSSPSPQLLVAAAQQTLGMGKRRSPPQAICLHLAGEVLAVARGLKPAVLYDCNCAGASELQSYLEELKGLGFLTFGLHILEIGENSLIVSPEHVCQHLEQVLLGTIAFVDVSSCQRHPSVCSLDQLQDLKALVAEIITHLQGLQRDLSLAVSYSRLHSSDWNLCTVFGILLGYPVPYTFHLNQGDDNCLALTPLRVFTARISWLLGQPPILLYSFSVPESLFPGLRDILNTWEKDLRTRFRTQNDFADLSISSEIVTLPAVAL

SEQ ID NO: 9817 - protein, 183 aa, Homo sapiens [sequence omitted]

SEQ ID NO: 9818 - protein, 283 aa, Homo sapiens
MCGPEHLLCCPKDLAMFPRQLSLTACLPGTPVSHKCHHIWLWVGVPAWHPRASRCGGAQPSSWLRQKAARAFWLSLPAAKLRHHSSRWLRRSGAFSSGSTLKPPPSPSPAPLCHADNLRTGRTRPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRLTQLDVDSHLAQCLAESTEDVTW

SEQ ID NO: 9819 - protein, 180 aa, Homo sapiens
MEAARRPRLGLSRRRPRPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRLTQLDVDSHLAQCLAESTEDVTW

SEQ ID NO: 9820 - protein, 147 aa, Homo sapiens
MEAWGLCAWPRGLRGNFHTCAPGLTQRHEVARPPLPGSSEDGSATPDTWQLAALPLGSLSSGQLCLHLRGTSTPAPTCVPLAPKLPPYVWVASEMWGRRHSRKKGIRGASTSSEHFIPQDATRSLSWRSRSVHRVLFPWKMCTLETA

SEQ ID NO: 9821 - protein, 112 aa, Homo sapiens
MEAARRPRLGLSRRRPRPAGGSPGAARSPLKSSLSDPRPFPGHPFRRTCGARAVPTGCFTGQEGTWNPPPGPCPSARHLIPAGPPGWSSSRLWRVPRPCAAAPCARRSSPPG

SEQ ID NO: 9822 - protein, 195 aa, Homo sapiens
  MOD_RES (1)..(1): Any amino acid
XEAARRPRLGLSRRRPRPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRSKNSSGMRRHRSPKLAANNNNNKRKGRARWLTPVIPAL

SEQ ID NO: 9823 - protein, 546 aa, Homo sapiens
MSSAWKTPRGSDAMPEIMVKIIGSKHFQYLVEKPKIKENDSLKTETQTMHQKPMTDNARQMSRDTPVPINFTDQQTTDNPDDVKEKKHPENNQKSENNQKLLTGANSSRFLDGNIPSQANVHCSSVPTGDQSLSYVHGIPRRKLRDWSLEQMVRGSSDQPEDIGQSPSGTTNEDAFLLALVRRELKSRPLSSNLLEKLQKELKILDPISSGFLLQSQLSRLFLKHEVPLQLPTVKILCQRFSKRGSPEMVNYEKLLWFLNSAASDYPQQNKAAADLRKTESHGTHSQSTPPQHSSSQPEVNRSLLEILKMALRTTNGRLNIDNLNLSFRKEDRSFSGCLPLPKVRAICGKHGLYLTLSLLETLLNHQDLGYQNEIKWQNFVEMLTRASSDLLSDLPTGKNEKKAPAPPMEPEVPEMSQSKTEHMKTPEEELQPESSPAETSACKDPLKPLKIRPVSQPFVNPAVKNKAEECETWIDRFRKLENALYLCDLSNTGVLEKERARRLIHNYNLIYNLSLSPQKIDQALRRFRSGENMLLEPALRYLKEL

SEQ ID NO: 9824 - protein, 180 aa, Homo sapiens
MSRGCSSDLRFHTWLGLRMLKNIIAVALLMLGKNEKKAPAPPMEPEVPEMSQSKTEHMKTPEEELQPESSPAETSACKDPLKPLKIRPVSQPFVNPAVKNKAEECETWIDRFRKLENALYLCDLSNTGVLEKERARRLIHNYNLIYNLSLSPQKIDQALRRFRSGENMLLEPALRYLKEL

SEQ ID NO: 9825 - protein, 237 aa, Homo sapiens
MSSAWKTPRGSDAMPEIMVKIIGSKHFQYLVEKPKIKENDSLKTETQTMHQKPMTDNARQMSRDTPVPINFTDQQTTDNPDDVKEKKHPENNQKSENNQKLLTGANSSRFLDGNVRAICGKHGLYLTLSLLETLLNHQDLGYQNEIKWQNFVEMLTRASSDLLSDLPTGKNEKKAPAPPMEPEVPEMSQSKTEHMKTPEEELQPESSPAETSACKDPLKPLKIRPVSQPFVNPAVKN

SEQ ID NO: 9826 - protein, 91 aa, Homo sapiens
MVCYLYWETFPSISHLLKITLSARDCHVCGLNLFIFMDPVENQALHPVIMALILMPSLHCFGNILILLFLKSPAQLFCRMSVDLALLFPHK

SEQ ID NO: 9827 - protein, 87 aa, Homo sapiens
MERNTIYTGWLQSNLILDPVENQALHPVIMALILMPSLHCFGNILILLFLKSPAQLFCRIGRFETGEEKTRRREGSDVTTEAAIGVM

SEQ ID NO: 9828 - protein, 148 aa, Homo sapiens
MPGGDTTPEEAAAPSCAGYNPGLLLFRAQKAQGACVTSTEGAWPRRASALYGGRKMRCGESGAGPDPRSNSAEVSSSQPALASKSQSKWGPTSNNPRGALTTTEFEMAGNRSQNIKHKQTALIAIPMSSQTPRMLGRPRNQGQLYPQP

SEQ ID NO: 9829 - protein, 208 aa, Homo sapiens
MDFSIIQYSKFMTLLAMSLQNLKTLHMSLEESIKWLGEVMAEIGPTHSQKSEDWNIFDVKQANAIIDYLKISLFQHYKLYEFMFYSAREEIVIGTEQVIEVVKSACGPFPNPLEEGISFDIYSTFIEPPTILDTEMKRLDQEQGPEESQPETDTSDMDPLVGFTIEDVKSVLDQVTDDILIGIQTEINEKLQIQEEAFNARIEKLKKA

SEQ ID NO: 9830 - protein, 84 aa, Homo sapiens
  MOD_RES (1)..(1): Any amino acid
XADPGGNHARIGALHMSLEESIKWLGEVMAEIGPTHSQKSEDWNIFDVKQANAIIDYLKISLFQHYKLYEFMFYSAREEIVIGT

SEQ ID NO: 9831 - protein, 198 aa, Homo sapiens
MESSRWDKDPPGERRPQQSQHWRSCGVGGAGEATRGGLFPVPFPSGDSWPEVTQHWMRFQGQGPWCPGLWTTPAHSHCKPQTGAVDNASPRQPHAPDQHEKNAGRQHLHLWSLACPPWLHSIPHIKGTILSEALSGFLVSDRRTKTVAGLRWLWLRKEATPTASRTTLSSSLAPRGRGVNTLGRGGCTLMVLSSDLCD

SEQ ID NO: 9832 - protein, 221 aa, Homo sapiens
MESSRWDKDPPGERRPQQSQHWRARDHGARGCGPRQPTATASPRPGLWITPAHGSHTPQTNTRRTQADNIFIYESWLIHHGTQMSSVLPQPPLVRGPWHNTNSPWDSWASRGKLRVCPCRTPRLHSSGCFSSKAGTALSPSLPVPGLRPQPPFLQKPLSILAPATPPALVSPTPPKLSPGQLSPHSVNVHWGPQGHLHLPRSGTTVLHAYLQTLSSPASHQ

SEQ ID NO: 9833 - protein, 226 aa, Homo sapiens
MAGLVVRGTQVSYIGQDCREIPEHLGRDCGHFAKRLDLSFNLLRSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 9834 - protein, 198 aa, Homo sapiens
MEKYLSLSGNHSSNKRSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 9835 - protein, 145 aa, Homo sapiens
MESMAPEISEDIGCPLAYMRESVCALLINQSFFSCVAEMYIPDMNRPGKAERRAEKGLRPPRKLVGETRRLQSWPTLARWLRRVSFSLYKPPIQAAPEPDPGNWAKSPRLSLGPEGITKGKHGFKFQGIKEKFNVSKKVLKMTFL

SEQ ID NO: 9836 - protein, 79 aa, Homo sapiens
MAKSERRIYSMESMAPEISEDIGCPLAYMRESVCALLINQSFFSCVAEMYIPDMNRLEERTAALYPIGLVRQNGEPRRA

SEQ ID NO: 9837 - protein, 155 aa, Homo sapiens
MAKSERRIYSMESMAPEISEDIGCPLAYMRESVCALLINQSFFSCVAEMYIPDMNRPGKAERRAEKGLRPPRKLVGETRRLQSWPTLARWLRRVSFSLYKPPIQAAPEPDPGNWAKSPRLSLGPEGITKGKHGFKFQGIKEKFNVSKKVLKMTFL

SEQ ID NO: 9838 - protein, 136 aa, Homo sapiens
MQSREPSGWRTAERRRGWRCRGVPTPSGDRGPGAARPAARGGAGETTGQQRPLQVPGASAAAARTRLLRWHHRVPSPRATRSPGSIRRTSPCSGGPDRPERPECADACCYLLDPFTLPLIQDFFRGCAASDFDRRD

SEQ ID NO: 9839 - protein, 94 aa, Homo sapiens
MFTRHTLFRQFAVLADTSFNYIKVKPLLVQSRTTMTAISSSSHCTSSIDGKHVDVVSDQAALQLSPKGKLSESPKEESLEEPSMRQSSPAETVD

SEQ ID NO: 9840 - protein, 94 aa, Homo sapiens; identical to SEQ ID NO: 9839

SEQ ID NO: 9841 - protein, 55 aa, Homo sapiens
MASKGLQDLKQQVEGTAQEAAMDQLAKTTQETIDKTANQASDTFSGIGKKFGLLK

SEQ ID NO: 9842 - protein, 76 aa, Homo sapiens
MASKGLQDLKQQVEGTAQEAVSAAGAAAQQVVDQATEAGQKAMDQLAKTTQETIDKTANQASDTFSGIGKKFGLLK

SEQ ID NO: 9843 - protein, 38 aa, Homo sapiens
MASKGLQDLKQQVEGTAQEAAMDQLAKTTQETIDKTAN

SEQ ID NO: 9844 - protein, 211 aa, Homo sapiens
MSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIESELLSTEFAEHRVPNGMNKGEHALVLFEKCVQDKYLQQEHIIKK

SEQ ID NO: 9845 - protein, 211 aa, Homo sapiens; identical to SEQ ID NO: 9844

SEQ ID NO: 9846 - protein, 898 aa, Homo sapiens
MSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIESELLSTEFAEHRVPNGMNKGEHALVLFEKCVQDKYLQQEHIIKKLIKENKKHQELFVDICSEKDNLREELKKRTETEKQHMNTIKQLESRIEELNKEVKASRDQLIAQDVTAKNAVQQLHKEMAQRMEQANKKCEEARQEKEAMVMKYVRGEKESLDLRKEKETLEKKLRDANKELEKNTNKIKQLSQEKGRLHQLYETKEGETTRLIREIDKLKEDINSHVIKVKWAQNKLKAEMDSHKETKDKLKETTTKLTQAKEEADQIRKNCQDMIKTYQESEEIKSNELDAKLRVTKGELEKQMQEKSDQLEMHHAKIKELEDLKRTFKEGMDELRTLRTKVKCLEDERLRTEDELSKYKEIINRQKAEIQNLLDKVKTADQLQEQLQRGKQEIENLKEEVESLNSLINDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLQKAHARKNEKIEFMEDHIKQLVEEIRKKTKIIQSYILREESGTLSSEASDFNKVHLSRRGGIMASLYTSHPADNGLTLELSLEINRKLQAVLEDTLLKNITLKENLQTLGTEIERLIKHQHELEQRTKKT

SEQ ID NO: 9847 - protein, 436 aa, Homo sapiens
  MOD_RES (1)..(1): Any amino acid
XRLIREIDKLKEDINSHVIKVKWAQNKLKAEMDSHKETKDKLKETTTKLTQAKEEADQIRKNCQDMIKTYQESEEIKSNELDAKLRVTKGELEKQMQEKSDQLEMHHAKIKELEDLKRTFKEGMDELRTLRTKVKCLEDERLRTEDELSKYKEIINRQKAEIQNLLDKVKTADQLQEQLQRGKQEIENLKEEVESLNSLINDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLQKAHARKNEKIEFMEDHIKQLVEEIRKKTKKIYKHLEQK

SEQ ID NO: 9848 - protein, 1004 aa, Homo sapiens
VGCVSHRGLFLPLLAGWTPLWKSWPLSQSSSSLVRAWPEAWISGRKKSWISSQNIWIRILLLSLDNLVTCGNQKREYSKNTQYSPRCKTKIRSRFEELQSELVPVSMSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIESELLSTEFAEHRVPNGMNKGEHALVLFEKCVQDKYLQQEHIIKKLIKENKKHQELFVDICSEKDNLREELKKRTETEKQHMNTIKQLESRIEELNKEVKASRDQLIAQDVTAKNAVQQLHKEMAQRMEQANKKCEEARQEKEAMVMKYVRGEKESLDLRKEKETLEKKLRDANKELEKNTNKIKQLSQEKGRLHQLYETKEGETTRLIREIDKLKEDINSHVIKVKWAQNKLKAEMDSHKETKDKLKETTTKLTQAKEEADQIRKNCQDMIKTYQESEEIKSNELDAKLRVTKGELEKQMQEKSDQLEMHHAKIKELEDLKRTFKEGMDELRTLRTKVKCLEDERLRTEDELSKYKEIINRQKAEIQNLLDKVKTADQLQEQLQRGKQEIENLKEEVESLNSLINDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLQKAHARKNEKIEFMEDHIKQLVEEIRKKTKIIQSYILREESGTLSSEASDFNKVHLSRRGGIMASLYTSHPADNGLTLELSLEINRKLQAVLEDTLLKNITLKENLQTLGTEIERLIKHQHELEQRTKKT

SEQ ID NO: 9849 - protein, 405 aa, Homo sapiens
MDSHKETKDKLKETTTKLTQAKEEADQIRKNCQDMIKTYQESEEIKSNELDAKLRVTKGELEKQMQEKSDQLEMHHAKIKELEDLKRTFKEGMDELRTLRTKVKCLEDERLRTEDELSKYKEIINRQKAEIQNLLDKVKTADQLQEQLQRGKQEIENLKEEVESLNSLINDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLQKAHARKNEKIEFMEDHIKQLVEEIRKKTKKIYKHLEQK

SEQ ID NO: 9850 - protein, 1247 aa, Homo sapiens
MQSSALVESLITVKMAAENSEEGNTCIIPQRNLFKALSEEAWNSGFMGNSSRTADKENTLQCPKTPLRQDLEANEQDARPKQENHLHSLGRNKVGYHLHPSDKGQFDHSKDGWLGPGPMPAVHKAANGHSRTKMISTSIKTARKSKRASGLRINDYDNQCDVVYISQPITECHFENQKSILSSRKTARKSTRGYFFNGDCCELPTVRTLARNLHSQEKASCSALASEAVFTPKQTLTIPAPRHTVDVQLPREDNPEEPSKEITSHEEGGGDVSPRKEPQEPEVCPTKIKPNLSSSPRSEETTASSLVWPLPAHLPEEDLPEGGSTVSAPTASGMSSPEHNQPPVALLDTEEMSVPQDCHLLPSTESFSGGVSEDVISRPHSPPEIVSREESPQCSENQSSPMGLEPPMSLGKAEDNQSISAEVESGDTQELNVDPLLKESSTFTDENPSETEESEAAGGIGKLEGEDGDVKCLSEKDTYDTSIDSLEENLDKKKKGKKFPEASDRCLRSQLSDSSSADRCLRNQSSDSSSACLEIKVPKNPSAKRSKKEGHPGGTTPKGLLPDSFHTETLEDTEKPSVNERPSEKDAEQEGEGGGIITRQTLKNMLDKEVKELRGEIFPSRDPITTAGQPLPGERLEIYVQSKMDEKNAHIPSESIACKRDPEQAKEEPGHIPTQHVEEAVNEVDNENTQQKDDESDAPCSSLGLSSSGSGDAARAPKSVPRPKRLTSSTYNLRHAHSLGSLDASKVTSEKEAAQVNPIMPKENGASESGDPLDEDDVDTVVDEQPKFMEWCAEEENQELIANFNAQYMKVQKGWIQLEKEGQPTPRARNKSDKLKEIWKSKKRSRKCRSSLESQKCSPVQMLFMTNFKLSNVCKWFLETTETRSLVIVKKLNTRLPGDVPPVKHPLQKYAPSSLYPSSLQAERLKKHLKKFPGATPAKNNWKMQKLWAKFRENPDQVEPEDGSDVSPGPNSEDSIEEVKEDRNSHPPANLPTPASTRILRKYSNIRGKLRAQQRLIKNEKMECPDALAVESKPSRKSVCINPLMSPKLALQVDADGFPVKPKSTEGMKGRKGKQVSEILPKAEVQSKRKRTEGSSPPDSKNKGPTVKASKEKHADGATKTPAAKRPAARDRSSQPPKKTSLKENKVKIPKKSAGKSCPPSRKEKENTNKRPSQSIASETLTKPAKQKGAGESSSRPQKATNRKQSSGKTRARPSTKTPESSAAQRKRKLKAKLDCSHSKRRRLDAK

SEQ ID NO: 9851 - protein, 989 aa, Homo sapiens
QPITECHFENQKSILSSRKTARKSTRGYFFNGDCCELPTVRTLARNLHSQEKASCSALASEAVFTPKQTLTIPAPRHTVDVQLPREDNPEEPSKEITSHEEGGGDVSPRKEPQEPEVCPTKIKPNLSSSPRSEETTASSLVWPLPAHLPEEDLPEGGSTVSAPTASGMSSPEHNQPPVALLDTEEMSVPQDCHLLPSTESFSGGVSEDVISRPHSPPEIVSREESPQCSENQSSPMGLEPPMSLGKAEDNQSISAEVESGDTQELNVDPLLKESSTFTDENPSETEESEAAGGIGKLEGEDGDVKCLSEKDTYDTSIDSLEENLDKKKKGKKFPEASDRCLRSQLSDSSSADRCLRNQSSDSSSACLEIKVPKNPSAKRSKKEGHPGGTTPKGLLPDSFHTETLEDTEKPSVNERPSEKDAEQEGEGGGIITRQTLKNMLDKEVKELRGEIFPSRDPITTAGQPLPGERLEIYVQSKMDEKNAHIPSESIACKRDPEQAKEEPGHIPTQHVEEAVNEVDNENTQQKDDESDAPCSSLGLSSSGSGDAARAPKSVPRPKRLTSSTYNLRHAHSLGSLDASKVTSEKEAAQVNPIMPKENGASESGDPLDEDDVDTVVDEQPKFMEWCAEEENQELIANFNAQYMKVQKGWIQLEKEGQPTPRARNKSDKLKEIWKSKKRSRKCRSSLESQKCSPVQMLFMTNFKLSNVCKWFLETTETRSLVIVKKLNTRLPGDVPPVKHPLQKYAPSSLYPSSLQAERLKKHLKKFPGATPAKNNWKMQKLWAKFRENPDQVEPEDGSDVSPGPNSEDSIEEVKEDRNSHPPANLPTPASTRILRKYSNIRGKLRAQQRLIKNEKMECPDALAVESKPSRKSVCINPLMSPKLALQVDADGFPVKPKSTEGMKGRKGKQVSEILPKAEVQSKRKRTEGSSPPDSKNKGPTVKASKEKHADGATKTPAAKRPAARDRSSQPPKKTSLKENKVKIPKKKEK

SEQ ID NO: 9852 - protein, 335 aa, Homo sapiens
MIREWKNDCQRIEKQRASDTMVQERKNEKPVRIFNTNSSFQDQAPTCCQEDLSSASPLRIWSKFYRSDPRIALGKYSPLEKEILRLGGIHTIAARRLLAYKQEEECRMLKELQLLSPDYKQAMEYKKKHSSPCAICVPLEKIWTAKVIAPLEAFKMPQREQVNVSKHIERMRLARALGNHQPLPYIERFTRSSFLSGVGLGPMAKNKARRKEDNYDTHNCDDANQDKKEEAEGKNTKRREIKMNVVFKSKEPKKCLTYHGNDRKSFLPAKKPERSIAGLTNRNLFCISEFPGDLMLMNQDFISRRDHFSDLVKTYSLEEESIWKERMRKATPYHY

SEQ ID NO: 9853 - protein, 159 aa, Homo sapiens
  MOD_RES (1)..(1): Any amino acid
XCQRIEKQRASDTMVQERKNEKPVRIFNTNSSFQDQAPTCCQEDLSSASPLRIWSKFYRSDPRIALGKYSPLEKEILRLGGIHTIAARRLLAYKQEEECRMLKELQLLSPDYKQAMEYKKKHSSPCAICVPLEKIWTAKVIAPLEAFKMPQREQNSLVT

SEQ ID NO: 9854 - protein, 186 aa, Homo sapiens
MTKGRRFNPPSDKDGRWFPHIGLTQKTPESITSATSKEPQSPHLPRQAEGKLPPIYKVREKQAVNNQFPFSVHDNRHSLENSGCYLDSGLGRKKISPDKRQHVSRNFNLWACDYVPSCLDGFSNNQISYVYKEAMVVSSFRRFPRCYKEIWNAFTFLPERSYTEVLKKKPKVRFTVDKKVVSSLES

SEQ ID NO: 9855 - protein, 134 aa, Homo sapiens
MVALKGVPALLSPELLYALARMGHGDEIVLADLNFPASSICQCGPMEIRADGLGIPQLLEAVLKLLPLDTYVESPAAVMELVPSDKERGLQTPVWTEYESILRRAGCVRALAKIERFEFYERAKKAFAVVATGC

SEQ ID NO: 9856 - protein, 109 aa, Homo sapiens
MEIRADGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 9857 - protein, 154 aa, Homo sapiens
MVALKGVPALLSPELLYALARMGHGDEIVLADLNFPASSICQCGPMEIRADGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 9858 - protein, 110 aa, Homo sapiens
MGHGDEIGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 9859 - protein, 172 aa, Homo sapiens
MNHCIQFSPQSLQRWLILPCYDLKLPIWANTTEFCPHGPRRASQDPQLLAWLPDQSLEVSLELYDWNSMTFTLFLETVEPVAVESEGSGIFSFVWQQLIFPAEARWCFSWAQDCGLDGSFPGSAHTEPFGKAAAGQGSVAGKEAKKAGPGFHRQLLYLQFQKRCLFNYPELL

SEQ ID NO: 9860 - protein, 159 aa, Homo sapiens
MNLGVSMLRILFLLDVGGAQVLATGKTPGAEIDFKYALIGTAVGVAISAGFLALKICMIRRHLFDDDSSDLKSTPGGLSDTIPLKKRAPRAHVLRDGPALGPLHLLFSVIGMLFARKLQASTLFSFKSLLQCHHCIMEGLFKAKPQFLQKVSCKSDHLS

SEQ ID NO: 9861 - protein, 117 aa, Homo sapiens
MLRILFLLDVGGAQVLATGKTPGAEIDFKYALIGTAVGVAISAGFLALKICMIRRHLFDDDSSDLKSTPGGLSGETTISPKASGQICANSPTTESEKFPKICLLTSRNDFSFCHQSG

SEQ ID NO: 9862 - protein, 172 aa, Homo sapiens
MNLGVSMLRILFLLDVGGAQVLATGKTPGAEIDFKYALIGTAVGVAISAGFLALKICMIRRHLFDDDSSDLKSTPGGLSDTIPLKKRAPRAHVLRDGPALGPLHLLFSVIGMLFARKLQASTLFSFKSLLQCHHCIMEGLFKAKPQFLQKHLARSVQIHQLQKVKSFPKYAY

SEQ ID NO: 9863 - protein, 129 aa, Homo sapiens
MNLGVSMLRILFLLDVGGAQVLATGKTPGAEIDFKYALIGTAVGVAISAGFLALKICMIRRHLFDDDSSDLKSTPGGLSDTIPLKKRAPRKLQASTLFSFKSLLQCHHCIMEGLFKAKPQFLQKRCTGD

SEQ ID NO: 9864 - protein, 115 aa, Homo sapiens
RILFLLDVGGAQVLATGKTPGAEIDFKYALIGTAVGVAISAGFLALKICMIRRHLFDDDSSDLKSTPGGLSGETTISPKASGQICANSPTTESEKFPKICLLTSRNDFSFCHQSG

SEQ ID NO: 9865 - protein, 256 aa, Homo sapiens
MSEEMDNITAEEIIDKHLQKDLDAEENQNVAKTLRGKVREKLKISKINKGEKSSTEQLIDSEIHQRSKLSPQTEVSLDESLSFFILSGEEGSALGKSSEQRPVNRSYPKCFSLGVNLQNVAESEEEEFMKEFILTDILKVKAADYEDDQEQIKKQKANIFVPSSSPVVNQRKLPKDMMPRILEDEGFYIQRKPEIYKKTCNKMENRLLKLEEAKCWFGESGEIMSLPTPIKQSWNFRLNVRKEPLNPLLKTIYRKL

SEQ ID NO: 9866 - protein, 176 aa, Homo sapiens
MGVQMSEEMDNITAEEIIDKHLQKDLDAEENQNVAKTLRGKVREKLKISKINKGEKSSTEQLIDSEIHQRSKLSPQTEVSLDESLSFFILSGEEGSALGKSSEQRPVNRSYPKCFSLGVNLQNVAESEEEEFMKEFILTDILKVKAADYEDDQEQIKKQKANIFVPSSSPGNILSQ

SEQ ID NO: 9867 - protein, 778 aa, Homo sapiens
MQQESERCRVRARRPDMALYVPKARRGAVLLKTGDEEESCGSPNSVVKEKQKESSLSQKEVFKDKPEARRLNINPDRKEHNCREEKKSSTKLRMDTCLQKTNRVCSKRGTTESKEVLSQGQQQGAPNAGVITNAPLQRHFKPKKVECLEVETTDVTGHERILLSQACLEISEAQVPSKPFQNVEFCDFSRHEPDGEAFEDKDLEGRIETDTKVLEILYEFPRVFSSVMKPENMIVPIKLSSDSEIVQQSMQTSDGILNPSSGGITTTSVPGSPDGVFDQTCVDFEVESVGGIANSTGFILDQKDTDSIPATMGHISLSESTNDTVSPVMIRECEKNDSTADELHVKHEPPDTAVLAHETHRDSGFKNVGDITNKACMMDTTGMSCSDHVTVDSPYVVAVRIADETSINTRSFSKFVGMSADATPLHVARSGNDTEDFSNPSACSDIYGESISSHFTESTGKLIESLSDCASSLPIKKIAGSNYNTFLDSELSMLNGTKVLSDSAVGIDLGSTGDTTEALHELRTAEEFKTEEQDDSGSIEFGVSFPDRESSSMETSIEPKATETSHTEGITAIEESWESMFNDDGDCLDPRLLQELSGNTKSRESIQEPRSDYYNHEVPDIDLSDCEFPHVIEIYDFPQEFHTEDLLRVFCSYQKKGFDIKWVDDTHALGVFSSPITARDALGIKHTMVKIRPLSQATRAAKAKARAYAEFLQPAKERPETSAALARRLVISALGVRSKQSKTEREAELKKLQEARERKRLEAKQREDIWEGRDQSTV

SEQ ID NO: 9868 - protein, 194 aa, Homo sapiens
MHIKPENHCSKLSGNTKSRESIQEPRSDYYNHEVPDIDLSDCEFPHVIEIYDFPQEFHTEDLLRVFCSYQKKGFDIKWVDDTHALGVFSSPITARDALGIKHTMVKIRPLSQATRAAKAKARAYAEFLQPAKERPETSAALARRLVISALGVRSKQSKTEREAELKKLQEARERKRLEAKQREDIWEGRDQSTV

SEQ ID NO: 9869 - protein, 778 aa, Homo sapiens; identical to SEQ ID NO: 9867

SEQ ID NO: 9870 - protein, 184 aa, Homo sapiens
MLSGNTKSRESIQEPRSDYYNHEVPDIDLSDCEFPHVIEIYDFPQEFHTEDLLRVFCSYQKKGFDIKWVDDTHALGVFSSPITARDALGIKHTMVKIRPLSQATRAAKAKARAYAEFLQPAKERPETSAALARRLVISALGVRSKQSKTEREAELKKLQEARERKRLEAKQREDIWEGRDQSTV

SEQ ID NO: 9871 - protein, 327 aa, Homo sapiens
MQQESERCRVRARRPDMALYVPKARRGAVLLKTGDEEESCGSPNSVVKEKQKESSLSQKEVFKDKPEARRLNINPDRKEHNCREEKKSSTKLRMDTCLQKTNRVCSKRGTTESKEVLSQGQQQGAPNAGVITNAPLQRHFKPKKVECLEVETTDVTGHERILLSQACLEISEAQVPSKPFQNVEFCDFSRHEPDGEAFEDKDLEGRIETDTKVLEILYEFPRVFSSVMKPENMIVPIKLSSDSEIVQQSMQTSDGILNPSSGGITTTSVPGSPDGVFDQTCVDFEVESVGGIANSTGFILDQKIQIPFLQLWVTSLCQRAQMTLLVQ

SEQ ID NO: 9872 - protein, 185 aa, Homo sapiens
QKLSGNTKSRESIQEPRSDYYNHEVPDIDLSDCEFPHVIEIYDFPQEFHTEDLLRVFCSYQKKGFDIKWVDDTHALGVFSSPITARDALGIKHTMVKIRPLSQATRAAKAKARAYAEFLQPAKERPETSAALARRLVISALGVRSKQSKTEREAELKKLQEARERKRLEAKQREDIWEGRDQSTV

SEQ ID NO: 9873 - protein, 106 aa, Homo sapiens
MMATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 9874 - protein, 106 aa, Homo sapiens; identical to SEQ ID NO: 9873

SEQ ID NO: 9875 - protein, 128 aa, Homo sapiens
MKHKYNTLSWYKKERSTQLRRFIVHQPEVGLFFFLRDVVYNYITEKTTCRCPLTQERPCDTGGKFGRIWICQPEELGKMQIWICQPEELGKMQIDKNRTMVQQMWYIWYGGLDTSTNSLLPILVRGMA

SEQ ID NO: 9876 - protein, 128 aa, Homo sapiens; identical to SEQ ID NO: 9875

SEQ ID NO: 9877 - protein, 128 aa, Homo sapiens; identical to SEQ ID NO: 9875

SEQ ID NO: 9878 - protein, 303 aa, Homo sapiens
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPVSQNFTAV

SEQ ID NO: 9879 - protein, 369 aa, Homo sapiens
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPEWVQMAPTLFSKFIPNILPPAVESELSEYAAQDQKFQRELIQNGFTRGDQSRKRAGDELAYNSSSACASSRGYR

SEQ ID NO: 9880 - protein, 246 aa, Homo sapiens
MNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPEWVQMAPTLFSKFIPNILPPAVESELSEYAAQDQKFQRELIQNGFTRGDQSRKRAGDELAYNSSSACASSRGYR

SEQ ID NO: 9881 - protein, 180 aa, Homo sapiens
MTTTPVLSRFASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPEWVQMAPTLFSKFIPNILPPAVESELSEYAAQDQKFQRELIQNGFTRGDQSRKRAGDELAYNSSSACASSRGYR

SEQ ID NO: 9882 - protein, 435 aa, Homo sapiens
MPVTHRKSDASDMNSDTSPSCRLRAFSRGGSLESRSSSSRSRSFTLDDESLKYLTHEEKDVLLFFEETIDSLDEDFEEPVLCDGGVCCLCSPSLEESTSSPSEPEDVIDLVQPAPGAGEAEGLPEGTQAAGPAPAGKEHRKQDAETPPPPDPPAPETLLAPPPLPSTPDPPRRELRAPSPPVEHPRLLRSVPTPLVMAQKISERMAGNEALSPTSPFREGRPGEWRTPAARGPRSGDPGPGPSHPAQPKAPRFPSNIIVTNGAAREPRRTLSRAAVSVQERRAQVLATIHGHAGAFPAAGDAGEGAPGGGSSPERVARGRGLPGPAESLRAGGQAPRGPALANGFPSAHEALKSAPSSFAPAGKSLCFRPGPALPSTRARQSFPGPRQPNGAQDWRRADSLPRPQGITVQFAGRGSSEEARREALRKLGLLRESS

SEQ ID NO: 9883 - protein, 239 aa, Homo sapiens
MAQKISERMAGNEALSPTSPFREGRPGEWRTPAARGPRSGDPGPGPSHPAQPKAPRFPSNIIVTNGAAREPRRTLSRAAVSVQERRAQVLATIHGHAGAFPAAGDAGEGAPGGGSSPERVARGRGLPGPAESLRAGGQAPRGPALANGFPSAHEALKSAPSSFAPAGKSLCFRPGPALPSTRARQSFPGPRQPNGAQDWRRADSLPRPQGITVQFAGRGSSEEARREALRKLGLLRESS

SEQ ID NO: 9884 - protein, 342 aa, Homo sapiens
MPVTHRKSDASDMNSDTSPSCRLRAFSRGGSLESRSSSSRSRSFTLDDESLKYLTHEEKDVLLFFEETIDSLDEDFEEPVLCDGGVCCLCSPSLEESTSSPSEPEDVIDLVQPAPGAGEAEGLPEGTQAAGPAPAGKEHRKQDAETPPPPDPPAPETLLAPPPLPSTPDPPRRELRAPSPPVEHPRLLRSVPTPLVMAQKISERMAGNEALSPTSPFREGRPGEWRTPAARGPRSGDPGPGPSHPPALANGFPSAHEALKSAPSSFAPAGKSLCFRPGPALPSTRARQSFPGPRQPNGAQDWRRADSLPRPQGITVQFAGRGSSEEARREALRKLGLLRESS

SEQ ID NO: 9885 - protein, 341 aa, Homo sapiens
MPVTHRKSDASDMNSDTSPSCRLRAFSRGGSLESRSSSSRSRSFTLDDESLKYLTHEEKDVLLFFEETIDSLDEDFEEPVLCDGGVCCLCSPSLEESTSSPSEPEDVIDLVQPAPGAGEAEGLPEGTQAAGPAPAGKEHRKQDAETPPPPDPPAPETLLAPPPLPSTPDPPRRELRAPSPPVEHPRLLRSVPTPLVMAQKISERMAGNEALSPTSPFREGRPGEWRTPAARGPRSGDPGPGPSHPALANGFPSAHEALKSAPSSFAPAGKSLCFRPGPALPSTRARQSFPGPRQPNGAQDWRRADSLPRPQGITVQFAGRGSSEEARREALRKLGLLRESS

SEQ ID NO: 9886 - protein, 85 aa, Homo sapiens
MPVTHRKSDASDMNSDTSPSCRLRAFSRGGSLESRSSSSRSRSFTLDDESLKYLTHEEKDVLLFFEETIDSLDEDFEEPVLCDGG

SEQ ID NO: 9887 - protein, 93 aa, Homo sapiens
MPKNAVVILRYGPYSAAGLPVEHHTFRLQGLQAVLAIDGHEVILEKIEDWNVVELMVNEEVIFHCNIKDLEFGGDGKLDPLCEKARIAVLNAY

SEQ ID NO: 9888 - protein, 157 aa, Homo sapiens
MPKNAVVILRYGPYSAAGLPVEHHTFRLQGLQAVLAIDGHEVILEKIEDWNVVELMVNEEVIFHCNIKDLEFGKLTPSSDKRTTSSSRLTFHQLSSPCRMKVSPLQQFPQKTQDLTCTVLAQIGSCIHFQTNLCDLGWPGLDHMLISGLEKRGTQPY

SEQ ID NO: 9889 - protein, 93 aa, Homo sapiens
MPKNAVVILRYGPYSAAGLPVEHHTFRLQGLQAVLAIDGHEVILEKIEDWNVVELMVNEEVIFHCNIKDLEFGKPFGDASSQQFASSEESLNF

SEQ ID NO: 9890 - protein, 157 aa, Homo sapiens; identical to SEQ ID NO: 9888

SEQ ID NO: 9891 - protein, 151 aa, Homo sapiens
MFLHLDSHSSLERTKPTVVGVDTHMELDEVHCCPGRDSGGGFIKGPMLQGLQGEGKLAPIPKPTLPSPSRLTLFVSSSQMEDHGFPARRNGLTQASFIYQMPAGWGSPGGLFLPCQPVPTPVVLKPPLPPCPISWGESGPAVDGIRRTPAP

SEQ ID NO: 9892 - protein, 151 aa, Homo sapiens; identical to SEQ ID NO: 9891

SEQ ID NO: 9893 - protein, 185 aa, Homo sapiens
MMALVRDRRAHYVMSIVIRWVHCFSSSLRGTFGTRWEAMKAKATELRVCCARRKREAREFKPPQMRGSTRLNISDDLKIGFFSTDHATQTDSSEILSVKELSSSTQKLAQMMKSLQVDFGFLKQLLQLKFEDRLKEESLSLFTILHDRILEIEKHYQQNEDKMRKSFNQQLADAIAVIKGMYQPL

SEQ ID NO: 9894 - protein, 296 aa, Homo sapiens
GRKIMEGLEASIEQFQFNPRLNISDDLKIGFFSTDHATQTDSSEILSVKELSSSTQKLAQMMKSLQVDFGFLKQLLQLKFEDRLKEESLSLFTILHDRILEIEKHYQQNEDKMRKSFNQQLADAIAVIKGMYQQFFEVEEENVSLQDASTVKTNILLRKLKEKEEVIKELKEELDQYKDFGFHKMESFAKETSSPKSNLEKENLEYKVENERLLQIISELEEEIQINLKENSGLEDELISMKEMAEKDHKTIQKLMDSRDRLREELHYEKSLVQDVINKQKEDKEMRKKYGSLSVK

SEQ ID NO: 9895 - protein, 628 aa, Homo sapiens
MTEEQTYQAAEKSQAHNEVPNERLVVEHQESLSKTKLQIKKQETSTEQPLTTPDKEPNENLILRHQDSMSKSEMQVKEQRTLKGQRIITHDEEPGKNLVLEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNTRIVVPNENVISVHQDSKSKLQMQEKKQINSGVERHKTFPLEIKKKDISLEHLLPEEKVLLSRSESQTKKLQAKVTSRKKTDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHGETDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTVGKPTYKVLHAAARKSVPHPYF

SEQ ID NO: 9896 - protein, 692 aa, Homo sapiens
MTEEQTYQAAEKSQAHNEVPNERLVVEHQESLSKTKLQIKKQETSTEQPLTTPDKEPNENLILRHQDSMSKSEMQVKEQRTLKGQRIITHDEEPGKNLVLEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNTRIVVPNENVISVHQDSKSKLQMQEKKQINSGVERHKTFPLEIKKKDISLEHLLPEEKVLLSRSESQTKKLQAKVTSRKIKNEAASELPDTAENLPAMYPSISDLIIQFDLNKVVETDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHGETDKEHLADDTGRGIIKGSINAQLKGHQKTDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTVGKPTYKVLHAAARKSVPHPYF

SEQ ID NO: 9897 - protein, 604 aa, Homo sapiens
AHNEVPNERLVVEHQESLSKTKLQIKKQETSTEQPLTTPDKEPNENLILRHQDSMSKSEMQVKEQRTLKGQRIITHDEESGENPMLKHQDSVSKIQVQLEIQETSEGEGRSIPDKNSMFVHQDSVSKLQMQEKKKITPGRERRNTRIVVPNENVISVHQDSKSKLQMQEKKQINSGVERHKTFPLEIKKKDISLEHLLPEEKVLLSRSESQTKKLQAKVTSRKKTDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHGETDKEHLADDTGRGIIKGSINAQLKGHQKTDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTVGKPTYKVLHAAARKSVPHPYF

SEQ ID NO: 9898 - protein, 719 aa, Homo sapiens
MMQGNKKCTDAFSDSSSIGSVLDDADREVSSLTDRAFRSLCISEDTSFHDSYLAVSPDITRQVFGTFHQRTVGHTQRKSGIWSQLPSQGTEHSGWAATFQQLPKYVQGEEKYPKTSPPPTPVQRRLEVPVSGLRSSNKPVSKVSTLIKSFDRTESQRCESRPTASKPPALKNPPKFAPLPENSVNFCFDSAFLTVRRVPAEVSNTHQNSYQPGRKHGEQESSKNPEMACHGSSSFLPAANDTATLCESKFPSPHHKPVTGEPGRGKGTFLHSENSAFESWNAHQPKLLERKDTAGTVPESKAPKHYGDTTLLREPCPPERTVSPCQVQASCSQEENRLAAGALSTSIPWGCRDPGAQVFAVEGKAPSSQPDSQEKPAQPPWRKPKTGKKGKESLQDTLEEKTQTNQRGPPLYTKHNPQEQFSENNALDLPVEPNEHYDPPFNISKLLTPIIPSKHALDSADSQPAERTPSPPGQLNGYQEKEPSECQSRDSYKSKAPSLLFNLKDVRKRVKSTYSSSPLLKVLDEKTRGKVDGKQEPVSNGVILPNGLEESPPNELSKERPADDPTASHINPQKDPTADPSEPSADSYLTLSTAPTIAKAPFYVNGEAAERSSYENKEVEGELEMGPAGSSWCPDSREHRPRKHLSLRLCNRDPEPGGATEKMKTHQLENGLSRSVSQETEPEREAGLQNTHTHTHTHTHTHDHQHILSLFRSIKSRRQ

SEQ ID NO: 9899 - protein, 1435 aa, Homo sapiens
MMQGNKKCTDAFSDSSSIGSVLDDADREVSSLTDRAFRSLCISEDTSFHDSYLAVSPDITRQVFGTFHQRTVGHTQRKSGIWSQLPSQGTEHSGWAATFQQLPKYVQGEEKYPKTSPPPTPVQRRLEVPVSGLRSSNKPVSKVSTLIKSFDRTESQRCESRPTASKPPALKNPPKFAPLPENSVNFCFDSAFLTVRRVPAEVSNTHQNSYQPGRKHGEQESSKNPEMACHGSSSFLPAANDTATLCESKFPSPHHKPVTGEPGRGKGTFLHSENSAFESWNAHQPKLLERKDTAGTVPESKAPKHYGDTTLLREPCPPERTVSPCQVQASCSQEENRLAAGALSTSIPWGCRDPGAQVFAVEGKAPSSQPDSQEKPAQPPWRKPKTGKKGKESLQDTLEEKTQTNQRGPPLYTKHNPQEQFSENNALDLPVEPNEHYDPPFNISKLLTPIIPSKHALDSADSQPAERTPSPPGQLNGYQEKEPSECQSRDSYKSKAPSLLFNLKDVRKRVKSTYSSSPLLKVLDEKTRGKVDGKQEPVSNGVILPNGLEESPPNELSKERPADDPTASHINPQKDPTADPSEPSADSYLTLSTAPTIAKAPFYVNGEAAERSSYENKEVEGELEMGPAGSSWCPDSREHRPRKHLSLRLCNRDPEPGGATEKMKTHQLENGLSRSVSQETEPEREAGLQNTHLNQKFFPGPLSPEEEDVFYSDSQSDFMPSLKGKAKFSTSSSDQSFASFDDQQKMWFTENQREDRRKDVSAGDSQKDEKENVMRKDELQYCALSNGHACLENRSQGEALQRERESVSGGRTRKASAEEANFRGSWIGENKGTTFSQAKDLTPSPSSASNRHMLFTIKDNTLRATPVIKPIMLPLLRTMSLEDSLSSGHKEEELPRPEWGEDPGFCAPENQDILGTSTPTNTRGTRVKCMANEVMEDPGQGSSMARMEASQPAPKGNFPSMPLVGEGDRVKAPPDAAPGLVASNCKSGSADSGKLAAPWHIPTIALPEGDIEDQPPPWQPENCWEEQTPGFKSHFLSTPRAGPPGRRLVPSERANSPNPGSPGESSACSPAASNIWEESSQAPGGPELLPEEPNQASPWASSSPARVTRREDLTHALVWEGGSDPLLELSAEDLRTLSPRGSLLDVATSPAGTSGRLELPAQLERTASKPPAVPPKTEKALRRAKKLASKRRKTDQAQEKHGESQEGKPCPEDLEQTQQRPLCPRERPRHNFPVVRSLPPPVHRHSVSGFSEPVGRRPGGPQSLTPLPAYPATQKVLQDPQSGEYFVFDLPLQVKIKTFYDPETGKYVKVSIPSSEGASPEPPPPDALAAPYVLYPGFQPVPVTALMPLRCSSQLSAPTFLRQGPRASAARARTQSVHESGLQLDPGPHGDCTPHSAGQRPHGPPQSPGEEGVEAPGLGIISTDDLEDFATEGIS

SEQ ID NO: 9900 - protein, 159 aa, Homo sapiens
PMRHRKKAADKNLPCRPLVCAVLDLMVEFIVTHMMKEFPMDLYIRCIQVVHKLLCYQKKCRVRLHYTWRELWSALINLLKFLMSNETVLLAKHNIFTLALMIVNLFNMFITYGDTFLPTPSSYDELYYEIIRMHQSFDNLYSMEPSSTTLTPKLSPTLL

SEQ ID NO: 9901 - protein, 198 aa, Homo sapiens
MESYFFKETSHESVDSSKEEPQTLPETQDGDLHLQEQGSGIDWCLSPADVEAQTTNDQKGNIPDESQVEKLNVFLSPPDVINYLALTEATGRICVSQWEGPPRLGCIFCHGDHLLAVNDLKPQSLEEVSLFLTRSIQKEKLKLTIGRIPNSETFHAASCMCPSKCQSAAPSQLDKPRLNRAPKRSPAIKKSQQKGARE

SEQ ID NO: 9902 - protein, 363 aa, Homo sapiens
MEPKPQKSPGKQFTFSYENEVCKQDYFIKSPPSQLFSSVTSWKKRFFILSKAGEKSFSLSYYKDHHHRGSIEIDQNSSVEVGISSQEKMQSVQKMFKCHPDEVMSIRTTNREYFLIGHDREKIKDWVSFMSSFRQDIKATQQNTEEELSLGNKRTLFYSSPLLGPSSTSEAVGSSSPRNGLQDKHLMEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGSASLTVVQLSILINNIPDESQVEKLNVFLSPPDVINYLALTEATGRI

SEQ ID NO: 9903 - protein, 282 aa, Homo sapiens
MEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGSASLTVVQLSILINNIPDESQVEKLNVFLSPPDVINYLALTEATGRICVSQWEGPPRLGCIFCHGDHLLAVNDLKPQSLEEVSLFLTRSIQKEKLKLTIGRIPNSETFHAASCMCPSKCQSAAPSQLDKPRLNRAPKRSPAIKKSQQKGARE

SEQ ID NO: 9904 - protein, 465 aa, Homo sapiens
MAGGKQFTFSYENEVCKQDYFIKSPPSQLFSSVTSWKKRFFILSKAGEKSFSLSYYKDHHHRGSIEIDQNSSVEVGISSQEKMQSVQKMFKCHPDEVMSIRTTNREYFLIGHDREKIKDWVSFMSSFRQDIKATQQNTEEELSLGNKRTLFYSSPLLGPSSTSEAVGSSSPRNGLQDKHLMEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGNIPDESQVEKLNVFLSPPDVINYLALTEATGRICVSQWEGPPRLGCIFCHGDHLLAVNDLKPQSLEEVSLFLTRSIQKEDSFRILSYQVAFGEGTELRDRAPGFRTSDRHDVAKRACMESDWCRDSKTAPSTNLCLSFLFCKIMTNDGAGCWIIK

SEQ ID NO: 9905 - protein, 366 aa, Homo sapiens
MQSVQKMFKCHPDEVMSIRTTNREYFLIGHDREKIKDWVSFMSSFRQDIKATQQNTEEELSLGNKRTLFYSSPLLGPSSTSEAVGSSSPRNGLQDKHLMEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGNIPDESQVEKLNVFLSPPDVINYLALTEATGRICVSQWEGPPRLGCIFCHGDHLLAVNDLKPQSLEEVSLFLTRSIQKEKLKLTIGRIPNSETFHAASCMCPSKCQSAAPSQLDKPRLNRAPKRSPAIKKSQQKGARE

SEQ ID NO: 9906 - protein, 196 aa, Homo sapiens
  MOD_RES (1)..(1): Any amino acid
XQEQGSGIDWCLSPADVEAQTTNDQKGSASLTVVQLSILINNIPDESQVEKLNVFLSPPDVINYLALTEATGRICVSQWEGPPRLGCIFCHGDHLLAVNDLKPQSLEEVSLFLTRSIQKEDSFRILSYQVAFGEGTELRDRAPGFRTSDRHDVAKRACMESDWCRDSKTAPSTNLCLSFLFCKIMTNDGAGCWIIK

SEQ ID NO: 9907 - protein, 154 aa, Homo sapiens
MEPSKTFMRNLPITPGYSGFVPFLSCQGMSKEDDMNHCVKTFQEKTQRYKEQLRELCCAVATAPKLKPVNSEETVLQALHQYNLQYHPLILECKYVKKPLQEPPIPGWAGYLPRAKVTEFGCGTRYTVMAKNCYKDFLEITERAKKAHLKPYEE

SEQ ID NO: 9908 - protein, 230 aa, Homo sapiens
MEPSKTFMRNLPITPGYSGFVPFLSCQGMSKEDDMNHCVKTFQEKTQRYKEQLRELCCAVATAPKLKPVNSEETVLQALHQYNLQYHPLILECKYVKKPLQEPPIPGWAGYLPRAKVTEFGCGTRYTVMAKNCYKDFLEITERAKKAHLKPYEEIYGVSSTKTSAPSPKVLQHEELLPKYPDFSIPDGSCPALGRPLREDPKTPLTCGCAQRPSIPCSGKMYLEPLSSAK

SEQ ID NO: 9909 - protein, 128 aa, Homo sapiens
MAWRVPGVRPASTFFPQVLRASSELPNRLPEGSTVGPKPDSSWEAGSQGNWGLTSSGAGQDSSAQKLGILSVQISLKIWTWEKPSGWGHLHAAVTGASCCSPLSQGGAICLVTAPQDKPDCSPCTSGH

SEQ ID NO: 9910 - protein, 445 aa, Homo sapiens
METRTEDGGLTRRPTLASSWDVAGGALTHSLLLTRAGLGPGDFDWEELLAPPAPGQDLVILKRNHNNKDENPCFLYLRCGPDGGEEIASIGILSSARNMEVYLGEEYCGTSRGKNVCTVLDDSEHEKIILYKKNLKLESSTHACKIKLLSFGERQCVFISKVVVHMRSVFANSSTSSPALGSRIDLDKVQTIMESMGSKLSPGAQQLMDMVRCQQRNCIPIGEQLQSVLGNSGYKHMIGLQSSSTLGTLNKSSSTPFPFRTGLTSGNVTENLQTYIDKSTQLPGGENSTKLDECKVMPQNHSFLENDLKNAMASFLPKKVSDNSNIPNSELLPFLQNLCSQVNHLHVGNKTECQENITKHGERILGVGMEEQSICSYLEKILSKNMELMEKKLMDYIDQRIHELQEHIDDKIALLLDLLQNPNSPPTGIPLRHYDSGERLSNGER

SEQ ID NO: 9911 - protein, 145 aa, Homo sapiens
MWSFLPGAESVSMGPVPGVSSLGACWTHDQDSGRAEDRPQAPRITQYTWVLSFLFTEKPQTRSTSPISHQGQPQTTRALSLRQPQHPSAPASGRPRPPHSSGPDLAEAAPVVDQASQAAGRASSGLGLWEQASVSQGFRNAAFEA

SEQ ID NO: 9912 - protein, 145 aa, Homo sapiens; identical to SEQ ID NO: 9911

SEQ ID NO: 9913 - protein, 257 aa, Homo sapiens
MERSNAATKCGEEPRSGSRRLPKAEGDKSGSAGAPSKNSSRLGGRPCMCTAGRRPNRASGRRRRSCSPAPTWPPLCCYPQSRPTASAAGPGACMRASGRPHGNTTASTAPPRHPRPRRPGGPALRPTPRPCAGPAPPPASRDCRCRRPRRWPRAGRRGRRAGACKPSCAGAAWSARGAPLCSYRTSCAGSCGARTAPTPAPTCASPSAAASSCCRRRRACSSPTTAWSGACGAGPTAATAAQPGKPRSAAAPGRARA

SEQ ID NO: 9914 - protein, 258 aa, Homo sapiens
MSLESLFQHIIFTEHQAEESRRLMREVRSEITRCREKIKKATEELNEEKIKLESKVQQFFEKSFFLQLLKAHENALEKQYSEITNHRNMLLQTFEAIKKQMIEEEDKFIKEITDFNNDYEITKKRELLMKENVKIEISDLENQANMLKSEMKSMEHDSSQLNELQKQKSELIQELFTLQRKLKVFEDEENESICTTKYLEAEKIKISEKPQNDTECLRLKKELELYKEDDMESVYEALQTEIEFLELTLAQKDLQESK

SEQ ID NO: 9915 - protein, 180 aa, Homo sapiens
MSLESLFQHIIFTEHQAEESRRLMREVRSEITRCREKIKKATEELNEEKIKLESKVQQFFEKSFFLQLLKAHENALEKQYSEITNHRNMLLQTFEAIKKQMIEEEDKFIKEITDFNNDYEITKKRELLMKENVKIEISDLENQANMLKSDRLKKELELYKEDDMESVYEALQTEIEFLEL

SEQ ID NO: 9916 - protein, 467 aa, Homo sapiens
MESSTGPRMPLLKYCSVATSLKAPGWDGAAPPWDLSFTYPFALQAPWLTGHKPLARHASSCPCLHVADPAWQGPGWLGRAGDAANTWVLARREADGFYYRAQIKATPELERQGVLLVEFEAPLVAGPKLPAQQQRVVLEEDVIPLSPSVGYSLRPGDKVLALWEPGQQQYGPGTVLLGLEMRDPQRASKEKEITVHFWNGKAAKVPLGGVQSVSLTIWKKAVERLHKSFTREHPRPLHWAPCCSLLGPITGRITNELPPDAPFLCPLCHHHACCQLLCQGCLCGCPPCGTTWWPLTRTSEVMARELPELEPTAQLLPLEGPKEEKVAMHAPLAVSSSSSSSCEQDGVENDLEMGPPQRLMVNSAVNTDPIFLEMPLRQSGLCQPEWRYWKRNGPEPCLGKPGTRYSNICKEEKDHKQQRAQTAVVGTTKELVSKATHMKPPRTPPGEAEHRKRSQSLAICQWNKNSR

SEQ ID NO: 9917 - protein, 404 aa, Homo sapiens
MESSTGPRMPLLKYCSVATSLKAPGWDGAAPPWDLSFTYPFALQAPWLTGHKPLARHASSCPCLHVADPAWQGPGWLGRAGDAANTWVLARREADGFYYRAQIKATPELERQGVLLVEFEAPLVAGPKLPAQQQRVVLEEDVIPLSPSVGYSLRPGDKVLALWEPGQQQYGPGTVLLGLEMRDPQRASKEKEITVHFWNGKAAKVPLGGVQSVSLTIWKKAVERLHKSFTREHPRPLHWAPCCSLLGPITGRITNELPPDAPFLCPLCHHHACCQLLCQGCLCGCPPCGTTWWPLTRTSEVMARELPELEPTAQLLPLEGPKEEKVAMHAPLAVSSSSSSSCEQDGVENDLEMGPPQRLMVNSAVNTDPIFLEMPLRQSGLCQPEWRYWKRNGPEPCLGKPGKE

SEQ ID NO: 9918 - protein, 122 aa, Homo sapiens
  MOD_RES (44)..(44): Selenocysteine
MAPRGRKRKAEAAVVAVAEKREKLANGGEGMEEATVVIEHCTSCRVYGRNAAALSQALRLEAPELPVKVNPTKPRRGSFEVTLLRPDGSSAELWTGIKKGPPRKLKFPEPQEVVEELKKYLS

SEQ ID NO: 9919 - protein, 94 aa, Homo sapiens
  MOD_RES (1)..(1): Any amino acid
  MOD_RES (16)..(16): Selenocysteine
XGMEEATVVIEHCTSCRVYGRNAAALSQALRLEAPELPVKVNPTKPRRGSFEVTLLRPDGSSAELWTGIKKGPPRKLKFPEPQEVVEELKKYLS

SEQ ID NO: 9920 - protein, 122 aa, Homo sapiens; identical to SEQ ID NO: 9918
  MOD_RES (44)..(44): Selenocysteine

SEQ ID NO: 9921 - protein, 634 aa, Homo sapiens
MRWLRPAGRRREQESVSGHLGPPAGAPAAPETPTCLPDTTPHPAPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSFVQVIGHPPRDHRASSEQALVQAGSYSRDSEDLQKTHSPRHGEPVLSPQPCTDPDHWSPELLQSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 9922 - protein, 158 aa, Homo sapiens
MDLASEITSATQTSSLCSSGRGHAGYPAPGIVAHGFETHGTARVAQGHLLPPCLLPPPQMPVLAALRDLSRRGSTSSSRSPSRPVSTSASKPCLPASCLGETWSISINLVGSSGHLQSPGAQRDAQRETGCLGPSWLPHHQGRDEELSLSHSAQGEEF

SEQ ID NO: 9923 - protein, 158 aa, Homo sapiens; identical to SEQ ID NO: 9922

SEQ ID NO: 9924 - protein, 28 aa, Homo sapiens
MDLASEITSATQTSSLCSSGRGHAGYPA

SEQ ID NO: 9925 - protein, 158 aa, Homo sapiens; identical to SEQ ID NO: 9922

SEQ ID NO: 9926 - protein, 140 aa, Homo sapiens
MKGQEGIRGEGCTDPEIKASPQMWAARFRGMRSRFSPLFSQATEMGPRVSAGWCLSGGGRKVSSLQGDFPPGGFWALSNDSALSLPPLSLPHPHPLRPPGLGVNEFTQGLHPPLHPAASVFQTCFYRKPHYCSTLRPTTT

SEQ ID NO: 9927 - protein, 217 aa, Homo sapiens
MALVQALVPREREPKLSILQMDRGDPQHSSHWCPEREKVKLLTLKPRETSKNILINFYRAFNLDKDVFIHQANHPLTVPSSVVMGDNGHTLAEDDKRPCFRVLPCYLERVSSGISISWISAPLPVGAMKHQLLCDLMDLITLSFWLAGQCMSLKATNMQHCKCSIATSDWAIELDRTDYKTLPSEYSILALLQVFAGKNCMDRVLLHVDVNYLKSLP

SEQ ID NO: 9928 - protein, 333 aa, Homo sapiens
MLVGTPNLLTLDEADATWTLIKDKVIEEHFGPNAVAVPFLSDAACYDLLGVLVKQSRPAHTRLALPGRQGRRALKPVGPLPSLLEQAGSEGAFAHCTREYSPNGRAERAYEETRMLDGQPCKIRLHMGDLRKKVAFLLLPPGQVSLQQTLPWLRSTHSIYVIYQVFSCSWLQLGLTSTAREPQLLRLLRSLPVAFSCLKFSLQSKGVLGPQKPLTKDPLPHGANWVRPNLSIMPPLAPTSAPADTTEAADVPPPVPAPPTPPPQEGPEDKPTRFSYKGRNPFWRGPQILSENWLFSPRSPPPGAQGGGPRDPDGHSMSLPLLQGLSSEFDSDD

SEQ ID NO: 9929 - protein, 263 aa, Homo sapiens
MALVPGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGFVEYSHLLPPNSFEGAEEEAVQTPAGVESGAASEAPGGRGCDRPRADHAAPPQEAGVQCTCQHYTVREEAQKTPPADPACPEREDSHGSGSPFKASQD

SEQ ID NO: 9930 - protein, 289 aa, Homo sapiens
MALVPGRSKEDGLWTRNSPGSSQHPESPRLPNPLWDRGKIGKVEGHQHIQVSTSSACVWQLAYPPVWPNLPAVPIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGFVEYSHLLPPNSFEGAEEEAVQTPAGVESGAASEAPGGRGCDRPRADHAAPPQEAGVQCTCQHYTVREEAQKTPPADPACPEREDSHGSGSPFKASQD

SEQ ID NO: 9931 - protein, 82 aa, Homo sapiens
MALVPGRSKEDGLWTRNSPGSSQHPESPRLPNPLWDRGKIGKVEGHQHIQDFSQKSHLPSIVVESSEVNEESGDLHLPHEEL

SEQ ID NO: 9932 - protein, 263 aa, Homo sapiens; identical to SEQ ID NO: 9929

SEQ ID NO: 9933 - protein, 331 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 9934 - protein, 337 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLLPFFRLAQVPGLVNSVTASPEASCLPSRTPPRVGSPWRPLHHSRKVDGESDGSTEETDESET

SEQ ID NO: 9935 - protein, 274 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERL

SEQ ID NO: 9936 - protein, 234 aa, Homo sapiens
MKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 9937 - protein, 247 aa, Homo sapiens
MELPGSSLNNLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 9938 - protein, 326 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLVVRSKLHRTSRQHRAKEPGAFGFQRREKQEALERVSSASVPTPYHYRWEPRE

SEQ ID NO: 9939 - protein, 121 aa, Homo sapiens
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNEVDMEGNEQDQDQWMI

SEQ ID NO: 9940 - protein, 121 aa, Homo sapiens; identical to SEQ ID NO: 9939

SEQ ID NO: 9941 - protein, 121 aa, Homo sapiens; identical to SEQ ID NO: 9939

SEQ ID NO: 9942 - protein, 121 aa, Homo sapiens; identical to SEQ ID NO: 9939

SEQ ID NO: 9943 - protein, 121 aa, Homo sapiens; identical to SEQ ID NO: 9939

SEQ ID NO: 9944 - protein, 45 aa, Homo sapiens
MSTLFPSLFPRVTETLWFNLDRPCVEETELQQQEQQHQAWLQSIA

SEQ ID NO: 9945 - protein, 121 aa, Homo sapiens; identical to SEQ ID NO: 9939

SEQ ID NO: 9946 - protein, 65 aa, Homo sapiens
MSTLFPSLFPRVTETLWFNLDRPCVEETELQQQEQQHQAWLQSIAEKDNNLVPIGKPASEHYDDE

SEQ ID NO: 9947 - protein, 121 aa, Homo sapiens; identical to SEQ ID NO: 9939

SEQ ID NO: 9948 - protein, 123 aa, Homo sapiens
MGNRVCCGGSWSCPSTFQKKKKTGSQTRRTLKPQPQQLQQNLPKGHETTGHTYERVLQQQGSQERSPGLMSEDSNLHYADIQVCSRPHAREVKHVHLENATEYATLRFPQATPRYDSKNGTLV

SEQ ID NO: 9949 - protein, 44 aa, Homo sapiens
MGNRVCCGGSWSCPSTFQKKKKTGSQTRRTLKPQPQQLQQNLPK

SEQ ID NO: 9950 - protein, 236 aa, Homo sapiens
MPGSPVTSGYYGVRRSFLSDSDFHNSKQFSNDVYTSSVGKPFPCESSAGQSHAALLEPYFPQEPYGDYRPPALTPNAGSLFSASPLPPLLPPPFPGDPAHFLFRDSWEQTLPDGLSQPDPVSADALLTLPPSTSCLSQLESGSIAQHRGSSWGSSLAGAQSYSLHALEDLHHTPGYPTPPPYPFTPFMTVSNDLPPKVGPLSPDEEADTGSLHDPSPWVKEDGSIAWGSYECRRAY

SEQ ID NO: 9951 - protein, 121 aa, Homo sapiens
MMRSIFLPHRKLICSRRGHLDPRGWEEDEKILVPDAIPTLPPYVFIRTDQACVKVYPGFVLIRNGKTHRHRGDCHEEEVCAHRTLETGGMACHVGPHGEGPSLWGFWGSWKQVLFFLPVDH

SEQ ID NO: 9952 - protein, 292 aa, Homo sapiens
MSRIPLGKVLLRNVIRHTDAHNKIQEESDMWKIRELEKQMEDAYRGTKRKMLPSSSSRMRSDGFDEESQRYYWRPKNEISGTLEDDFLKAKSWNKKFYDYEANMPDRWGHSGYKELYPEEFETDSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 9953 - protein, 293 aa, Homo sapiens
MSRIPLGKVLLRNVIRHTDAHNKIQEESDMWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 9954 - protein, 147 aa, Homo sapiens
MNPANTRSQRNPTKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 9955 - protein, 292 aa, Homo sapiens; identical to SEQ ID NO: 9952

SEQ ID NO: 9956 - protein, 215 aa, Homo sapiens
MWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEE

SEQ ID NO: 9957 - protein, 91 aa, Homo sapiens
MSRIPLGKVLLRNVIRHTDAHNKIQEESDMWKIRELEKQMEDAYRGTKRKMLPSSSSRMRSDGFDEESQRYYWRPKNEISGTLEDDFLKAK

SEQ ID NO: 9958 - protein, 264 aa, Homo sapiens
MWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 9959 - protein, 292 aa, Homo sapiens; identical to SEQ ID NO: 9952

SEQ ID NO: 9960 - protein, 183 aa, Homo sapiens
MSAARESHPHGVKRSASPDDDLGSSNWEAADLGNEERKQKFLRLMGAGKKEHTGRLVIGDHKSTSHFRTGEEDKKINEELESQYQQSMDSKLSGRYRRHCGLGFSEVEDHDGEGDVAGDDDDDDDDSPDPESPDDSESDSESEKEESAEELQAAEHPDEVEDPKNKKDAKSNYKMMFVKSSGS

SEQ ID NO: 9961 - protein, 139 aa, Homo sapiens
MGAGKKEHTGRLVIGDHKSTSHFRTGEEDKKINEELESQYQQSMDSKLSGRYRRHCGLGFSEVEDHDGEGDVAGDDDDDDDDSPDPESPDDSESDSESEKEESAEELQAAEHPDEVEDPKNKKDAKSNYKMMFVKSSGS

SEQ ID NO: 9962 - protein, 507 aa, Homo sapiens
MAAPCGSELPANSPLKIPKMEVLSPASPGGLSDGNPSLSDPSTPRGASPLGPGSAAGSGAAASGGLGLGLGGRSAASSSVSFSPGGGGGGAAAAAAAACRGMSWTPAETNALIAVWGNERLVEARYQQLEGAGTVFGSKAPGPAMYERVSRALAELGYERTPSQCRERIKELESDGSTMEDYSQEDWGNHSQDLHGYPTDQELDEIPVTKRTLKIKQESSEEAQKRDIMQNIVQILESVQLKWELFQSWTDFSRLHLSNKLAIFGIGYNTRWKEDIRYHYAEISSQVPLGKRLREYFNSEKPEGRIIMTRVQKMNWKNVYYKFLEITISEARCLELHMEIDWIPIAHSKPTGGNVVQYLLPGGIPKSPGLYAIGYEECIERPLSPHMEQSSLDPGKEGRVDLETLSAQASLQVEIEPTRIIYCYLGIAEVRTLQQCLFLHFQANTKTFSKDWVGINGFLSQNCIVDPGVSPKSIYIKFVEVERDFLSAGSLVECLEKAIGYPLKFNN

SEQ ID NO: 9963 - protein, 559 aa, Homo sapiens
MAAPCGSELPANSPLKIPKMEVLSPASPGGLSDGNPSLSDPSTPRGASPLGPGSAAGSGAAASGGLGLGLGGRSAASSSVSFSPGGGGGGAAAAAAAACRGMSWTPAETNALIAVWGNERLVEARYQQLEGAGTVFGSKAPGPAMYERVSRALAELGYERTPSQCRERIKTLRRCYSRVKEHGVGKRKSSYTFEQLEQVFGQGGWDAQPCQPVLINSSGLYQELESDGSTMEDYSQEDWGNHSQDLHGYPTDQELDEIPVTKRTLKIKQESSEEAQKRDIMQNIVQILESVQLKWELFQSWTDFSRLHLSNKLAIFGIGYNTRWKEDIRYHYAEISSQVPLGKRLREYFNSEKPEGRIIMTRVQKMNWKNVYYKFLEITISEARCLELHMEIDWIPIAHSKPTGGNVVQYLLPGGIPKSPGLYAIGYEECIERPLSPHMEQSSLDPGKEGRVDLETLSAQASLQVEIEPTRIIYCYLGIAEVRTLQQCLFLHFQANTKTFSKDWVGINGFLSQNCIVDPGVSPKSIYIKFVEVERDFLSAGSLVECLEKAIGYPLKFNN

SEQ ID NO: 9964 - protein, 329 aa, Homo sapiens
MEDYSQEDWGNHSQDLHGYPTDQELDEIPVTKRTLKIKQESSEEAQKRDIMQNIVQILESVQLKWELFQSWTDFSRLHLSNKLAIFGIGYNTRWKEDIRYHYAEISSQVPLGKRLREYFNSEKPEGRIIMTRVQKMNWKNVYYKFLEITISEARCLELHMEIDWIPIAHSKPTGGNVVQYLLPGGIPKSPGLYAIGYEECIERPLSPHMEQSSLDPGKEGRVDLETLSAQASLQVEIEPTRIIYCYLGIAEVRTLQQCLFLHFQANTKTFSKDWVGINGFLSQNCIVDPGVSPKSIYIKFVEVERDFLSAGSLVECLEKAIGYPLKFNN

SEQ ID NO: 9965 - protein, 778 aa, Homo sapiens
MSKRKLIPKLSIQSPVLHTNLNVQSTHPPLKKEDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQISYPVRVTDKTSIQNAKEMENAAIDPEDKWHQRAQQLKNYQEHWSQYESTKSSNVPRGQPSDMVNDHQPSRRPAKLKIRKQCKHQNGLKSSTTEEVTASQGNQNNPPRQQQNQNKPLDTSTKPESIVIMHASNNDVQASRALRSHNLKETSNTFAPPKQAFDKVLSKNSTGCDSGLNVNKERGHKDQEEKRFSYQQLHTLSDMDLNNLNELSKRHVLLSQKGSQFVYHINTHGSTKNKKQLKQPYTETKYRNLEMLWKFHSSSDSQTVRASPDSWLTQIMEQHQQALVQLTDVQPSEGALSSVTLPPILSRVESESQLSSERSQRNQVKISRSNSEGYLFQLEKGKKHKKRSSSKNTKLKGYQKRDVKLGGLGPDFESIRDKTQKLIQQKEYAKQVKEYNMKTLSILSKPQTEKTQKKSAIPRQKALEYAKTIPKPKPSNLTHQASKEQKNPTYAGKEESLPEISLLEILQNRHEREKQAVAAFKVLHIV

SEQ ID NO: 9966 - protein, 307 aa, Homo sapiens
MSKRKLIPKLSIQSPVLHTNLNVQSTHPPLKKEDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQVILRVNSLPRDGFKTFWSQ

SEQ ID NO: 9967 - protein, 778 aa, Homo sapiens; identical to SEQ ID NO: 9965

SEQ ID NO: 9968 - protein, 313 aa, Homo sapiens
MPWKEESEFTKQDKAARVIQQAWKSFLNVAIFQHFKSLIDLRRQGEPRQIVKYINPKEAELLDAAAGIHVRFRLGGVKFPPDIYYKIFTHRPIEDLCANSPRNYAKLPAKHTSHNKNDHLQEEDHSGWYHRIENNGWRPVSDTFWLSTDGMVVEDKKESEFHFSKLKRRQDLEKKRKLRKIEWMRQMYYSGSLEAKSTHHETLGLIHTATKGLIRAFEDGGIDSVMEWEVDEVLNWTNTLNFDEYIASWKEIATSNSSANFKGFRFNQAQKNIYNYGGDISKMQMGIPDDTYYENVYQEPNVTRLTPDSTYGL

SEQ ID NO: 9969 - protein, 313 aa, Homo sapiens; identical to SEQ ID NO: 9968

SEQ ID NO: 9970 - protein, 122 aa, Homo sapiens
MTSPEIASLSWGQMKVKGSNTTYKDCKVWPGGSRTWDWRETGTEHSPGVQPADVKEVVEKGVQTLVIGRGMSEALKVPSSTVEYLKKHGIDVRVLQTEQAVKEYNALVAQGVRVGGVFHSTC

SEQ ID NO: 9971 - protein, 122 aa, Homo sapiens; identical to SEQ ID NO: 9970

SEQ ID NO: 9972 - protein, 293 aa, Homo sapiens
MAAAAAAAVAGVGRGGGGAEPRQERSRARGWAGVERSEGRSRMEPGEELEEEGSPGGREDGFTAEHLAAEAMAADMDPWLVFDARTTPATELDAWLAKYPPSQVTRYGDPGSPNSEPVGWIAVYGQGYSPNSGDVQGLQAAWEALQTSGRPITPGTLRQLAITHHVLSGKWLMHLAPGFKLDHAWAGIARAVVEGQLQVAKVSPRAKEGGRQVICVYTDDFTDRLGVLEADSAIRAAGIKCLLTYKPDVYTYLGIYRANRWHLCPTLYESRFQLGGSARGSRVLDRANNVELT

SEQ ID NO: 9973 - protein, 292 aa, Homo sapiens
MAAAAAAAVAGVGRGGGGAEPRQERSRARGWAGVERSEGRRMEPGEELEEEGSPGGREDGFTAEHLAAEAMAADMDPWLVFDARTTPATELDAWLAKYPPSQVTRYGDPGSPNSEPVGWIAVYGQGYSPNSGDVQGLQAAWEALQTSGRPITPGTLRQLAITHHVLSGKWLMHLAPGFKLDHAWAGIARAVVEGQLQVAKVSPRAKEGGRQVICVYTDDFTDRLGVLEADSAIRAAGIKCLLTYKPDVYTYLGIYRANRWHLCPTLYESRFQLGGSARGSRVLDRANNVELT

SEQ ID NO: 9974 - protein, 54 aa, Homo sapiens
MLGRIKAQAFGFDQTFQSYRKDDFVMGFFQRPKCYSQFEVTFRFFWTMDHIRFC

SEQ ID NO: 9975 - protein, 267 aa, Homo sapiens
MATGELGDLGGYYFRFLPQKTFQSLSSKEITSRLRQWSMLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVSVRKNPQTKKIQITSSVFKVSAYDSAGMCYPSAKNHEQTFSYFIVDPIRRHLHVLYHCYGVGDMS

SEQ ID NO: 9976 - protein, 99 aa, Homo sapiens
MATGELGDLGGYYFRFLPQKTFQSLSSKEITSRLRQWSMLGRIKAQAFGFDQTFQSYRKDDFVMAFFKDPNVIPNLKLLSDSSGQWIILGFASGRLRKI

SEQ ID NO: 9977 - protein, 147 aa, Homo sapiens
MALNNVSLSSGDQRSRVAYRSSHGDLRPRASALAMVSGDGFLVSRPEAIHLGPRQAVRPSVRAESRRVDGGGRSPREPDGRGRSRQARFSPYPIPAVEPDLLRSVLQQRLIALGVTTWTLKLSESATPDLRWCSTCSHSNIFEILVI

SEQ ID NO: 9978 - protein, 251 aa, Homo sapiens
MTQLPELGLRSPNNKSPTGPHPLEHLLARLLKRRRRSTLMSSPRSLLCSISGPGSHLLSTHPILCHSVYQPPQPASRPQAKRYQGLLPVPLAPHPLCLSGQLYLPNIPCTVIDGCGPVISHLKLTMYPWGLPPSHLGSSSPFSANMEQWDYYKSQTRFAPFLPESFCGSPLPSEQSSRPFGLAFKVLCAATCQPPQFQLLWLCPYKLDLHQRICLPPNLALVLLGALWTSPPPGSFLQPPYNRPYKLYKTN

SEQ ID NO: 9979 - protein, 251 aa, Homo sapiens; identical to SEQ ID NO: 9978

SEQ ID NO: 9980 - protein, 221 aa, Homo sapiens
MSAHMSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQVDNFLDLEDLDMDEEIKPQMSEDLLLLPGEVEQDVSTSIPSCIPFVAQPPTCEVKPKPSVKRMDKQTEEILGDEVQLFSLDEEFDYDNVMLTSKFSPAEIENIKELCKQQKRKDTSPDLEKSCD

SEQ ID NO: 9981 - protein, 147 aa, Homo sapiens
MSAHMSGLEIMDEDQLIKDVLDKFLNCHEQTYDEEFLNTFTHLSQDLLLLPGEVEQDVSTSIPSCIPFVAQPPTCEVKPKPSVKRMDKQTEEILGDEVQLFSLDEEFDYDNVMLTSKFSPAEIENIKELCKQQKRKDTSPDLEKSCD

SEQ ID NO: 9982 - protein, 167 aa, Homo sapiens [sequence omitted]

SEQ ID NO: 9983 - protein, 90 aa, Homo sapiens
MSAHMSGLEIMDEDQLIKDVLDKFLNCHEQTYDEEFLNTFTHLSQDLLLLPGEVEQDVSTSIPSCIPFVAQPPTCEVKPKPSVKRMDKQT

SEQ ID NO: 9984 - protein, 83 aa, Homo sapiens
MSAHMSGLEIMDEDQLIKDVLDKFLNCHEQTYDEEFLNTFTHLSQEDHVSKRGVFGTDSSENIFTSAKVTHKNEADDYHLRNK

SEQ ID NO: 9985 - protein, 180 aa, Homo sapiens
MSAHMSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQVDNFLDLEDLDMDEEIKPQMSEDLLLLPGEVEQDVSTSIPSCIPFVAQPPTCEVKPKPSVKRMDKQTEEILGDEVQLFSLDEE

SEQ ID NO: 9986 - protein, 119 aa, Homo sapiens
MSAHMSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQVDNFLDLEDLDMDEEIKPQMSE

SEQ ID NO: 9987 - protein, 147 aa, Homo sapiens; identical to SEQ ID NO: 9981

SEQ ID NO: 9988 - protein, 486 aa, Homo sapiens
MVASAGSLFGGMVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVSRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 9989 - protein, 677 aa, Homo sapiens
MGSRCRAWAWTRAWALAEFQARAEEGAAAAAAAAGGYPSTGRCRCSLRGMEGTAVAVFEILRFLIIHWKCDIDVSKGALLEGQLVISIEGLNSKHQANALHCVTTRWSLTLLPRPECSGAVSAHCNLHLPGSSDSHASVPRVAGITDAHHHAWLIMVASAGSLFGGMVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 9990 - protein, 511 aa, Homo sapiens
MVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVSRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 9991 - protein, 381 aa, Homo sapiens
MALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPAPPPGLRGTLDLQVIRVRMEEPPAVSLLQDWSRHPQGTKRVGAGDTSDWPTVLSESSTTVAGKPEKGNGV

SEQ ID NO: 9992 - protein, 216 aa, Homo sapiens
MSLKPFTYPFPETRFLHAGPNVYKFKIRYGKSIRGEEIENKEVITQELEDSVRVVLGNLDNLQPFATEHFIVFPYKSKWERVSHLKFKHGEIILIPYPFVFTLYVEMKWFHENLSPGKPISDSPLGLVPVEKKAVGAVMRKRKHMDEPSSPSRPGLDRIGKEKPNKDCRRLWPLISLMSRNKILSGDTACQGELSHPCSTTHLHLRSEQPPASLGF

SEQ ID NO: 9993 - protein, 216 aa, Homo sapiens; identical to SEQ ID NO: 9992

SEQ ID NO: 9994 - protein, 148 aa, Homo sapiens
MKWFHENLSPGKPISDSPLGLVPVEKKAVGAVMRKRKHMDEPSSPSRPGLDRAKIGTSSQGPSKKKPPVETRRNRERKTQQGLQETLASDITDVQKQDSEWGHSLPGRIVPPLQHNSPPPKERAATGFFGFLSSLFPFRYFFRKSSHS

SEQ ID NO: 9995 - protein, 115 aa, Homo sapiens
MGTGLRSQSLREPRPSYGKLQEPWGRPQEGQLRRALSLRQGQEKSRSQGLERGTEGPDATAQERVPGSLGDTEQLIQAQRRGSRWWLRRYQQVRRRWESFVAIFPSVTLSQPASP

SEQ ID NO: 9996 - protein, 169 aa, Homo sapiens
METGPSEEPSGRKESQEMCPPGLLVFAGSSEQDANLAKQFWISASMYPPSESQLVLRRDSSQRLPVARPRRSRGSENSHSSQSFHLASNKNRDIFAEALKIQESEEKVKYLQKAKTREEILQLLRKQREERISKELISLPYKPKAKEHKAKKVVSESDKEDQEEVKTLD

SEQ ID NO: 9997 - protein, 178 aa, Homo sapiens
METGPSEEPSGRKESQEMCPPGLLVFAGSSEQDANLAKQFWISASMYPPSESQLVLRRDSSQRLPVARPRRSRGSENSHSSQSFHLASNKNRDIFAEALKIQESEEKVKYLQKTRSHSVTQNEVQWHDHGSLQPQLSRIQAKTREEILQLLRKQREERISKELISLPYKPKAKEHKAK

SEQ ID NO: 9998 - protein, 479 aa, Homo sapiens
MLISAASMAPEVCGPSLQGTPGPPPPLLPKPGKDNLRLQKLLRKAARKKMMGGTHLAPPRAFRTSLSPVSEASHDQEVTAPHAAEGPHPAEAPRLPEAPRPAEAPRMVAALPRSPHTPIIHHVASPLQKSTFSIGLTQRRILAAQFRAMGPQVVASAPEPTRPPSGFVPVSGGGGTHVTQVHIQLAPSPHNGTPEPPRTAPEVGSNSQDGDATPSPPRAQPLVPVAHIRPLPTTVQAASPLPEEPPVPRPPPGFQASVPREASARVVVPIAPTCRSLESSPHSLVPMGPGREHLEEPPMAGPAAEAERVSSPAWASSPTPPSGPHPCPVPKVAPKPRLSGWTWLKKQLLEEAPEPPCPEPRQSLEPEVPTPTEQEVPAPTEQEVPALTAPRAPASRTSRMWDAVLYRMSVAEAQGRLAGPSGGEHTPASLTRLPFLYRPRFNARKLQEATRPPPTVRSILELSPQPKNFNRTATGWRLQ

SEQ ID NO: 9999 - protein, 193 aa, Homo sapiens
MPKGRRGSHSPTMSQRSAPPLYFPSLYDRGISSSPLSDFNIWKKLFVPLKAGGAPVGGAAGARSLSQALPAPAPPPPPPPGLGPSSERPWPSPWPSGLASIPYEPLRFFYSPPPGPEVVASPLVPCPSTPRLASASHPEELCELEIRIKELELLTITGDGFDSQSYTFLKALKDEKLQGLKTKQPGKKSASLS

SEQ ID NO: 10000 - protein, 184 aa, Homo sapiens
MPKGRRGSHSPTMSQRSAPPLYFPSLYDRGISSSPLSDFNIWKKLFVPLKAGGAPVGGAAGARSLSQALPAPAPPPPPPPGLGPSSERPWPSPWPSGLASIPYEPLRFFYSPPPGPEVVASPLVPCPSTPRLASASHPEELCELEIRIKELELLTITGDGFDSQSFLGLWTTCADAGRIPQPTS

SEQ ID NO: 10001 - protein, 124 aa, Homo sapiens
MESCSVAQAGVLTSPFMWRWTGMAGALSALDNTIEDDADDQLPCGEGRPGWVRGELLGSQGVCKDSKDLFVPTSSSLYGCFCVGLVSGMAISVLLLASDFRKLDFSRPEPCFEKEASLWFVAQH

SEQ ID NO: 10002 - protein, 124 aa, Homo sapiens; identical to SEQ ID NO: 10001

SEQ ID NO: 10003 - protein, 124 aa, Homo sapiens; identical to SEQ ID NO: 10001

SEQ ID NO: 10004 - protein, 154 aa, Homo sapiens
MHPEPLLNSTQSAPHHFPDSFQATPFCFNQSLIPGSPSNSSILSGSLDYSYSPVQLPSYAPENYNSPASLDTRTCGYPPEDHSYQHLSSHAQYSCFSSATTSICYCASCEAEDLDALQAAEYFYPSTDCVDFAPSAAATSDFYKRETNCDICYS

SEQ ID NO: 10005 - protein, 154 aa, Homo sapiens; identical to SEQ ID NO: 10004

SEQ ID NO: 10006 - protein, 107 aa, Homo sapiens
MHPEPLLNSTQSAPHHFPDSFQATPFCFNQSLIPGSPSNSSILSGSLDYSYSPVQLPSYAPENYNSPASLDTRTCGYPPEDHSYQHLSSHAQYSCFSSATTSICYCA

SEQ ID NO: 10007 - protein, 435 aa, Homo sapiens
MGNKQPQKVTVPTGTALQGVVLIVSTLHQPGGWICGKDPCCSLRPLSNSVQNALACKSKQDYQAGILFKTRAFISRDCGSDAAEDSASKGETYTLTLEHKGAGEGDLRPRGQPGWCRLGDPRRDSARPVAAIEGPCPGAARASRVLRGRGFSRNPRGRGLPSGAGWRGAGGAGEGAVTFPERRGDVRRKGAGRARFKWHSLSSELRAVWAAAGYISREPGRRGADGDSSGGERLGARRNSAPRAPCPPTGPPARPPSRGAPARAREGRRHPAADLDPPPGEPPAAASRGAPAQRPPSESPGAPPPGPADAGGAMAAKPGELMGICSSYQAVMPHFVCLADEFPQPVRPAKLPKGRGRLRRPRQSRFKTQPVTFDEIQEVEEEGVSPMEEEKAKKSFLQSLECLRRSTQSLSLQREQLSSCKLRNSLDSSDSDSAL

SEQ ID NO: 10008 - protein, 417 aa, Homo sapiens [sequence omitted]

SEQ ID NO: 10009 - protein, 273 aa, Homo sapiens
MLGQLLPHTARGLGAAEMPGQGPGSDWTERSSSAEPPAVAGTEGGGGGSAGYSCYQNSKGSDRIKDGYKVNSHIAKLQELWKTPQNQTIHLSKSMMEASFFKHPDLTTGQKRYLCSIAKIYNANYLKMLMKRQYMHVLQHSSQKPGVLTHHRSRLSSRYSQKQHYPCTTWRHQLEREDSGSSDIAAASAPEMLIQHSLWRPVRNKEGIKTGYASKTRCKSLKIFRRPRKLFMQTVSSDDSESHMSEEKKEEDLLNNFMQSMSIEEQGEHLMLT

SEQ ID NO: 10010 - protein, 603 aa, Homo sapiens
MAASCPLPVTPDLPTLRAKLQGLLQFLRDALSISNAHTVDFYTESVWEELVDLPPETVLAALRKSASETEALPSETRPLVEAEWEAGMTDFPKIFCETSQKLVSVEAFALAAKYYSVQNLGICTPFEQLLVALRGNQNQRIGENQKAVEFMNMKKSHEVQAMSELISSIADYYGIKQVIDLGSGKGYLSSFLSLKYGLKVYGIDSSNTNTHGAEERNRKLKKHWKLCHAQSRLDVNGLALKMAKERKVQNKVKNKADTEEVFNNSPTNQEKMPTSAILPDFSGSVISNIRNQMETLHSQPHQEENLCFENSFSLINLLPINAVEPTSSQQIPNRETSEANKERRKMTSKSSESNIYSPLTSFITADSELHDIIKDLEDCLMVGLHTCGDLAPNTLRIFTSNSEIKGVCSVGCCYHLLSEEFENQHKERTQEKWGFPMCHYLKEERWCCGRNARMSACLALERVAAGQGLPTESLFYRAVLQDIIKDCYGITKCDRHVGKIYSKCSSFLDYVRRSLKKLGLDESKLPEKIIMNYYEKYKPRMNELEAFNMLKVVLAPCIETLILLDRLCYLKEQEDIAWSALVKLFDPVKSPRCYAVIALKKQQ

SEQ ID NO: 10011 - protein, 275 aa, Homo sapiens
MAFCALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGSGNYNYNIPVNKHTPTNVKFSLEINTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 10012 - protein, 325 aa, Homo sapiens
MKRLGSVQRKMPCVFVTEVKEEPSSKREHQPFKVLATETVSHKALDADIYSAIPTEKVDGTCCYVTTYKDQPYLWARLDRKPNKQAEKRFKNFLHSKENPKEFFWNVEEDFKPAPECWIPAKETEQINGNPVPDENGHIPGWVPVEKNNKQYCWHSSVVNYEFEIALVLKHHPDDSGLLEISAVPLSDLLEQTLELIGTNINGNPYGLGSKKHPLHLLIPHGAFQIRNLPSLKHNDLVSWFEDCKEGKIEGIVWHCSDGCLIKVHRHHLGLCWPIPDTYMNSRPVIINMNLNKCDSAFDIKCLFNHFLKIDNQKFVRLKDIIFDV

SEQ ID NO: 10013 - protein, 452 aa, Homo sapiens
MLACLQRTQNAPGQHLACPSKSLELRKCEAVASAMHSSRYPSPAELDAYAEKVANSPLSIKIFPTNIRVPQHKHLSRTVNGYDTSGQRYSPYPQHTAGYQGLLAIVKAAVSSSSTAAPAGPAKSVLKSAEGKRTKLSPAAVQVGIAPYPVPSTLGPLAYPKPPEAPAPPPGLPAAATAASVIPLPGRGLPLPPSNLPSIHSLLYQLNQQCQAPGAAPPACQGMAIPHPSPAKHGPVPSFPSMAYSAAAGLPDCRKGTELGQGATQALTLAGAAKPAGYADSGLDYLLWPQKPPPPPPQPLRAYSGSTVASKSPEACGGRAYERASGSPLNCGVGLPTSFTVGQYFAAPWNSVLVTPTSDCYNPAAAVVVTELGPGAARELAGPPADALSGLPSKSVCNTSVLSSSLQSLEYLINDIRPPCIKEQMLGKGYETVAVPRLLDHQHAHIRLPVYR

SEQ ID NO: 10014 - protein, 452 aa, Homo sapiens; identical to SEQ ID NO: 10013

SEQ ID NO: 10015 - protein, 1747 aa, Homo sapiens
MNWNEKPKSATLPPLYPKSQPPFLHQSLINQITTTSQSSFSYPGSNQEACMYPGNSNPISQPLLNIQNYPQQISVSDMHNGTVVASHTSVERITYANVNGPKQLTHNLQMSSGVTQNVWLNSPMRNPVHSHIGATVSHQTDFGANVPNMPALQSQLITSDTYSMQMQMIPSNSTRLPVAYQGNQGLNQSFSEQQVDWTQQCISKGLTYPDYRPPPKLYRYSPQSFLPDSTIQKQNFIPHTSLQVKNSQLLNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNSKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDSSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLATCLSLWKKQPSDTAKEKECDKLRTNTTAVGISKPANIHVKSPCSVVGNSNSQNKISNPSQQTALSMVMHNYESSGINITKGTELQIAVVSPLVLSEVKTLSVKGITPAVLPETVYPVIKEGSVCSLQNQLAENAKATAALKVDVSGPVASTATSTKIFPLTQKEKQNESTNGNSEVTPNVNQGKHNKLESAIHSPMNDQQISQESRNSTVVSSDTLQIDNICSLVEGDTSYNSQIAKIFSSLPLKMVEPQKPSLPNQQGIGSREPEKQLDNTTENKDFGFQKDKPVQCTDVSHKICDQSKSEPPLESSFNNLETNRVILEKSSLEHATEKSTANDTCSSAAIQEDIYPQEIDASSNYTPQDPARNEIHSDKAPVLYLHDQLSELLKEFPYGIEAVNTREGSVGQQTTYQTSEDQTADKTSSDSKDPADQIQITILSSEQMKEIFPEQDDQPYVVDKLAEPQKEEPITEVVSQCDLQAPAAGQSRDSVILDSEKDDIHCCALGWLSMVYEGVPQCQCNSIKNSSSEEEKQKEQCSPLDTNSCKQGERTSDRDVTVVQFKSLVNNPKTPPDGKSHFPELQDDSRKDTPKTKHKSLPRTEQELVAGQFSSKCDKLNPLQNHKRKKLRFHEVTFHSSNKMTASYEQASQETRQKKHVTQNSRPLKTKTAFLPNKDVYKKHSSLGQSLSPEKIKLKLKSVSFKQKRKLDQGNVLDMEVKKKKHDKQEQKGSVGATFKLGDSLSNPNERAIVKEKMVSNTKSVDTKASSSKFSRILTPKEYLQRQKHKEALSNKASKKICVKNVPCDSEHMRPSKLAVQVESCGKSNEKHSSGVQTSKESLNGLTSHGKNLKIHHSQESKTYNILRNVKEKVGGKQPDKIWIDKTKLDKLTNISNEAQFSQMPPQVKDQKKLYLNRVGFKCTERESISLTKLESSPRKLHKDKRQENKHKTFLPVKGNTEKSNMLEFKLCPDILLKNTNSVEERKDVKPHPRKEQAPLQVSGIKSTKEDWLKFVATKKRTQKDSQERDNVNSRLSKRSFSADGFEMLQNPVKDSKEMFQTYKQMYLEKRSRSLGSSPVK

SEQ ID NO: 10016 - protein, 675 aa, Homo sapiens
MNWNEKPKSATLPPLYPKSQPPFLHQSLINQITTTSQSSFSYPGSNQEACMYPGNSNPISQPLLNIQNYPQQISVSDMHNGTVVASHTSVERITYANVNGPKQLTHNLQMSSGVTQNVWLNSPMRNPVHSHIGATVSHQTDFGANVPNMPALQSQLITSDTYSMQMQMIPSNSTRLPVAYQGNQGLNQSFSEQQVDWTQQCISKGLTYPDYRPPPKLYRYSPQSFLPDSTIQKQNFIPHTSLQVKNSQLLNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNSKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDSSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLAT

SEQ ID NO: 10017 - protein, 35 aa, Homo sapiens
MNWNEKPKSATLPPLYPKSQPPFLHQSLINQITTT

SEQ ID NO: 10018 - protein, 138 aa, Homo sapiens
MERFLNSKARRLGSCSHPAFYLLCVPDEDTSCSTIYLPLKRRADPDQLFSDLLGGTQRLWSNRFGNEESFPGRVRALVDTFCWIARAPPLGNPLRLEERIAWRIQRLKSGQTALIEKKKQKIEEDVRHQCQQTTCDRC

SEQ ID NO: 10019 - protein, 138 aa, Homo sapiens; identical to SEQ ID NO: 10018

SEQ ID NO: 10020 - protein, 552 aa, Homo sapiens
MKKNRERFCNREREFVYKFKVGSQCLELRVPLKFPVQENASHLHGRLMLLHSLPCFIEKDLKEALTQFIEEESLSDYDRDAEASLAAVKSGEVDLHQLASTWAKAYAETTLEHARPEEPSWDEDFADVYHDLIHSPASETLLNLEHNYFVSISELIGERDVELKKLRERQGIEMEKVMQELGKSLTDQDVNSLAAQHFESQQDLENKWSNELKQSTAIQKQEYQEWVIKLHQDLKNPNNSSLSEEIKVQPSQFRESVEAIGRIYEEQRKLEESFTIHLGAQLKTMHNLRLLRADMLDFCKHKRNHRSGVKLHRLQTALSLYSTSLCGLVLLVDNRINSYSGIKRDFATVCQECTDFHFPRIEEQLEVVQQVVLYARTQRRSKLKESLDSGNQNGGNDDKTKNAERNYLNVLPGEFYITRHSNLSEIHVAFHLCVDDHVKSGNITARDPAIMGLRNILKVCCTHDITTISIPLLLVHDMSEEMTIPWCLRRAELVFKCVKGFMMEMASWDGGISRTVQFLVPQSISEEMFYQLSNMLPQIFRVSSTLTLTSKH

SEQ ID NO: 10021 - protein, 552 aa, Homo sapiens; identical to SEQ ID NO: 10020

SEQ ID NO: 10022 - protein, 652 aa, Homo sapiens
MNWVGGSRSRVLIKQERRKQKEYFEKHRLKSKMKSLGVLSPVKNSAVSLDILNLYMVNQISCKKKIPETVRKPTHVNMNRDIKMPLRKHNLELTMSPHCVPSKLCLDDTETNVNCQRLSSKEDLGPVQSQGMDSYSMLHPQFSKIENCSFTPSSFSVELPSNRHISKLNFTSGIAPTPQKLAYEKKQNDQRSTVNCSDSLLSKLNKSQDVFSPSHKTTRFGTLFERLNSLGNRNLLTKSPAVIMDEDCRSTDEIRQSDYITEKHSIQHIWGKNGKEVSNFLEDVNQSTPNLLSENCDSFVSQNMINVLNIDEQRIKKTFNKCDYDSMGDTCVVTSSDKNHVTDRCIRNIFTVPELTFSNSTLNKTSYPEKCQPNKKYQREYNKNERNDLSTSFENDYYPSSSERKEKFENDYQEKTPQKSIQKYPANSMGNIPSEELHSKQSWDFGLDEILMEEGGIYSLKSKRISTKKISLDSAQSSRSTSYSPRPTDSCFSSSSDLPSEDEDQISQQIEDSNRMTIKTKEKMNNFYVERMAKLSGDRIVKNDDKIHKQNENFYQFSVKNNTDQFPQLQCNSAHILQNKTNDNCVLQAARCDAGIQTESESVMEEKLDVAIQCDLISKCTCRSDVSLCNLERCSGNIKADTTGGQEIHKNN

SEQ ID NO: 10023 - protein, 394 aa, Homo sapiens
MNRDIKMPLRKHNLELTMSPHCVPSKLCLDDTETNVNCQRLSSKEDLGPVQSQGMDSYSMLHPQFSKIENCSFTPSSFSVELPSNRHISKLNFTSGIAPTPQKLAYEKKQNDQRSTVNCSDSLLSKLNKSQDVFSPSHKTTRFGTLFERLNSLGNRNLLTKSPAVIMDEDCRSTDEIRQSDYITEKHSIQHIWGKNGKEVSNFLEDVNQSTPNLLSENCDSFVSQNMINVLNIDEQRIKKTFNKCDYDSMGDTCVVTSSDKNHVTDRCIRNIFTVPELTFSNSTLNKTSYPEKCQPNKKYQREYNKNERNDLSTSFENDYYPSSSERKEKFENDYQEKTPQKSIQKYPANSIWCTKCSEFKVIFTLIHYVLMLNLFLKSLRTAFQAFLNNDLQL

SEQ ID NO: 10024 - protein, 107 aa, Homo sapiens
MSTVICMKQREEEFLLTIRPFANRMQKSPCYIPIVSSATLWDRSTPSAKHIPCYERTSVPCSRFINHMKNFSESPKFRSLHFLNFPGSHHGQATQKLQGAMVLHLEE

SEQ ID NO: 10025 - protein, 360 aa, Homo sapiens
MSTVICMKQREEEFLLTIRPFANRMQKSPCYIPIVSSATLWDRSTPSAKHIPCYERTSVPCSRFINHMKNFSESPKFRSLHFLNFPVFPERTQNSMACKRLLHTCQYIVPRCSVSTVSFDEESYEEFRSSPAPSSETDEAPLIFTARGETEERARGAPKQAWNSSFLEQLVKKPNWAHSVNPVHLEAQGIHISRHTRPKGQPLSSPKKNSGSAARPSTAIGLCRRSQTPGALQSTGPSNTELEPEERMAVPAGAQAHPDDIQSRLLGASGNPVGKGAVAMAPEMLPKHPHTPRDRRPQADTSLHGNLAGAPLPLLAGASTHFPSKRLIKVCSSAPPRPTRRFHTVCSQALSRPVVNAHLH

SEQ ID NO: 10026 - protein, 360 aa, Homo sapiens; identical to SEQ ID NO: 10025

SEQ ID NO: 10027 - protein, 207 aa, Homo sapiens
MSTVICMKQREEEFLLTIRPFANRMQKSPCYIPIVSSATLWDRSTPSAKHIPCYERTSVPCSRFINHMKNFSESPKFRSLHFLNFPVFPERTQNSMACKRLLHTCQYIVPRCSVSTVSFDEESYEEFRSSPAPSSETDEAPLIFTARGETEERARGAPKQAWNSSFLEQLVKKPNWAHSVNPVHLEAQGIHISRHTRPKGQPLSSPK

SEQ ID NO: 10028 - protein, 185 aa, Homo sapiens
MEVHGKPKASPSCSSPTRDSSGVPVSKELLTAGSDGRGGIWDRLLINSQPKSRKTSTLQTVRIERSPLLDQVQTFLPQMARANEKLRKEMAAAPPGRFNIENIDGPHSKVIQMDVALFEMNQSDSKEVDSSEESSQDSSENSSESEDEDDSIPSEVTIDNIKLPNSEGGKGKIEVLDSPASKKKK

SEQ ID NO: 10029 - protein, 414 aa, Homo sapiens
MEMQQNCSISCFWETQPLGCVKISCIFYHSKPRNINGLFLPPSSNITLQKEIQEGIPLQSQSQEPLKPQENISRPIHHPLVLKTNFEEEEEVDEQNDASSLWTKTPEEIEEKRAIKEMCYKSGEYYRFHTPPDILSSKSMTPTAEKQLEKPLENGSELQEGDSLTVPTKLSQYERQGEIKTSLHGKPKTDIAAFENGGGDCYVPQRVIFLGVDESEALTEEKEITISKCSNTKDNKDSPHPKHSLTTRLVPTTHVLNATENISMKCREDPSSMNDVQPVKKPHFKGVKKRKWIYDEPQNFPNSGMQRAVQAPRPQNKMSYHRNNKNRNAENASYIHVQRDAVRTVALNAPSRSRPTHGSYNKVHANREPKPNLSPDKYTSTSYNDSAWRKRIPFSKTYSKSEKIYPEPRRNGSK

SEQ ID NO: 10030 - protein, 97 aa, Homo sapiens
MEMQQNCSISCFWETQPLGCVKISCIFYHSKPRNINGLFLPPSSNITLQKEIQEGIPLQSQSQEPLKPQENISRPIHHPLVLKTNFEEEEEVDEQNG

SEQ ID NO: 10031 - protein, 127 aa, Homo sapiens
MAQHPCQDQEQKVEMTSKQQRSTSIEETMRPQEKQVTITETLWDQVLTVFKDIQKELQEDARIRGMSNCSMTPMTSAPRTGSIRPPDSLMTPKLRRLQFSSGEQPSGGRIHNLKTQLFSQSAYYPGP

SEQ ID NO: 10032 - protein, 127 aa, Homo sapiens; identical to SEQ ID NO: 10031

SEQ ID NO: 10033 - protein, 462 aa, Homo sapiens
MASPLPSGFPARRNSRLDVFLRRHLPPEVYDAVRAYEPCIVVSNSENHILKYVVLSDRLVYLTENPPKSIRRVVALRDVVAIDLIDDYPEFLSSPDREISQHIRIIYSSTVLKKECKKSNSVRKFLFPFHHTKANNKKVKEEKNGLAFWRSKESRSLKESPLRSEEKIKHFSQLKSELFLKDNSLRRILSLLMELKVAAQKNFILKRLFWKTSDLFYFIVNKLHEYLPESRDKNALQNQSQRVDELVACIEIIQTLVLMFRETETESSRLNTLAAKKGALFNLLVILISEPQIPKSCPVFDIQLVADSALVRMSFDAELQKLILEYTNTATALLYEILLVFQQGNLGLGSTKFAISWIMSFLQSCPPIITFVASIVKQVVRGLSASFQLLSPCQAVLLYQQFYILKSCLRHSRTLAEYIRNNYREEFRYFIHMPALQKRLPLCYPITQPTIQLFHEVLKLVE

SEQ ID NO: 10034 - protein, 625 aa, Homo sapiens
MASPLPSGFPARRNSRLDVFLRRHLPPEVYDAVRAYEPCIVVSNSENHILKYVVLSDRLVYLTENPPKSIRRVVALRDVVAIDLIDDYPEFLSSPDREISQHIRIIYSSTVLKKECKKSNSVRKFLFPFHHTKANNKKVKEEKNGLAFWRSKESRSLKESILPDRDQQESSTPSKDSTLCPRPGLKKLSLHGQGAFRPLPSPSRRSSQSAPTTGKAVSEPSCTTNTKEPQGLPDHNSISEIPFKCNGNGNEFYLGNSLLDSPSQSNSNLEKKESELHLYVISTTSSIFLHLKSSWNNYIIVKATLLQDPFYASEFSPAIGSQKPYRSEEKIKHFSQLKSELFLKDNSLRRILSLLMELKVAAQKNFILKRLFWKTSDLFYFIVNKLHEYLPESRDKNALQNQSQRVDELVACIEIIQTLVLMFRETETESSRLNTLAAKKGALFNLLVILISEPQIPKSCPVFDIQLVADSALVRMSFDAELQKLILEYTNTATALLYEILLVFQQGNLGLGSTKFAISWIMSFLQSCPPIITFVASIVKQVVRGLSASFQLLSPCQAVLLYQQFYILKSCLRHSRTLAEYIRNNYREEFRYFIHMPALQKRLPLCYPITQPTIQLFHEVLKLVE

SEQ ID NO: 10035 - protein, 126 aa, Homo sapiens
MASASTQPAALSAEQAKVVLAEVIQAFSAPENAVRMDEARDNACNDMGKMLQFVLPVATQIQQEVIKAYGFSCDGEGVLKFARLVKSYEAQDPEIASLSGKLKALFLPPMTLPPHGPAAGGSVAAS

SEQ ID NO: 10036 - protein, 245 aa, Homo sapiens
MSSESEKDKERLIQAAKMFFFHVQDLASVINTLTELFSRSMNTQILLMAVKNNSYIKDFFEQMLKIFKEMQSVVDARHDKIQKESLCSKVAMAMCSVVQKSTNVEELHQSAKEVFKSAHTPVIISVLNSSNILGSLESSLSHLMKFPIMNLQLSDFYTEDTKEQSDVTTSERTRSPPGSSKTTMIDTLKKLQDVLKTEDSKNPTKSAADLLEQIVKAMGPILEILQKAIKTMEMNISVFKKASDK

SEQ ID NO: 10037 - protein, 131 aa, Homo sapiens
MGGKSAVRHQLVLDCPREAASSAPALRPLGAAATSRAAPLAPLPAPSPRWGLGCGRVRYPGPHPRRAVEPAAGPLSAPIIAGGHPAEAAAGSAKQQPRHSREVPRPPVPQHPSGNSRSALQEAKTEQTKTP

SEQ ID NO: 10038 - protein, 805 aa, Homo sapiens
MAAQGSPSSSPSDDSTTSGSLPELPPTSTATSRSPPESKGSSRSSLLQWTCPEDSLPLAVFYGPLDAKNPLLASCEKEIQELLGFMRKKKALATTEEEKHEFRRRCATSLFNIWTKYAPRLPADYYNEKLLKVGDSLCQMKEYKLALLQCYGRYLQQFNTNFDENKVDVTQFKATFFPKGFKDKTAGLTFHALSGKNMCNYQLVCDSDENLKNKESVVQCLHILSSLRLIMQVALPQEHLCWIIFNGTIYIYTICRKLMVIGQSSKALEYLLWASMCMESLVPLLSLRYLTWRATLYTAVCQCCYDCHAGIHGEAFARRALAKIDELRQLELMSSSKSQEESRRYFREATMKMAVMIFKRGVFESRRKNKAVFRPKIRINLREVQTLSWPRTVTERLLDEMFDSTASQFLAVLEALSDSNRRILQTGPIVTDEVEIHDVVSELFMAGKELLIMSNIGADGMLDFPKTSLLELMIGRKDVISVDAAVKFIKLAFTYEEWSLFESSAVHLIYFLQRQDDPESKKAEKDLTLLIAMEPLINVKRNKGLIFPLENYKEGQSTQIYLKKIAVHDTCLKTCGYSEDIFHLAATLYVCVCTAPQDVQPDKEIVVDTIMFLWQKCKLGIQRLNISRNDYAKFTQKISTNKWIYLLWQINEVIHCYKMEDIDIVVVAEVTLRLSEILESLGSPGRKFKQSLDVPLREGTNKFPGAPKGITEILPILQKNPVEQLLFAYKLLDRAIGGINLNCMLTSLPNGSSVIDHCYAKRTHHIDGDTYKPLASNSFMMDLHLELIQAQHRIAVVLLDKLQGS

SEQ ID NO: 10039 - protein, 1197 aa, Homo sapiens
MSDENMSKTQTVYDSDSQSGSSAKEKDRGANLCVMDHFMKIFLYCRRAMVLAHRGGYWTLLQNCCRALWNFTQELQILLKQAVDLDKTFPISQDGFLCTSVLPFYLGAELLIDMLIQLQNTSSIKPIEDKGEFSVPSCYGNIKNDNGGSSLTFEHPLDDVNVVDLKWIHDFVLKSLEVLYQVEKWETLVSLAIQFNTVSHERYTEQVTPLLVYAQRQLLLRIQKFKGPDITQQPCARYEAEYGEKITCRNFIGKQLKINSSTIEATSNCTDLLKMLISSEYSRAKALVCVPVDVTDTLRCFRETLEKSKYHNRSIRHSRKLLSLFLAQTQDVLQASNQRSLKVQALHSLGSLLIFAEKKRAAFKCWCQALDDIFRKPDVLHTWKEFGPSLTNVTNSHSPPGFKDYSEEFLSRVGIWGCLQGAVISAKIAQFIKSLNVEKKTDCCILSALLFQGLLRTTLPHPKAERCYAQYEITQLLPGIELFSDRYRADICSVIASLYYIIRELHFVRQNLIVLPLLALYQYFVSGICQDITRNLEARILKIEVLIDLRFFSEAFYEISQIFYGKNMPCPIPAGYKATGKMKIFQSFDSGKLLTSKENIQAIDELRNKGLPAVLVTIGQPHLLNKFNFVKAYFFLSVAATINCVPENKFKTVITNKSKPNLPNLEEIYSKDDGSSFYNLTKLKDEITLSMLKSMLLMEAEDRLNFLLSEVEQKTLSQCSAGELEIVVEARLQLAAVALQRHRAAYSAAIVFSTLTLLQDSKLFEKKVVQDDTENPVSPGTSVTENKDDSEFLDPISLNAREYFNIHLWLRCRLALVTAFVAQIHGIGIVKEDDMTDCLSLINEVCMEAKSAGDTELQAEFLTQAVILGLQEKHLKADIMTNLQDIIHLLEGNEFISPQSRLTLARSLVLLDDLTKAEKFKESPSSKTGKLNLLTRAHSILTEQMLAFGETIEFRSSNTKYANPLQPLKNIYLPHVMLLAKIKMRIGHTVAKQVYYKNKRKDPSKWLPALHLFDVALKLCRTTAVEEHEVEAEILFQKGKIERQILMEEKSPSFQLESLYEAIQLSLKNDQNSGLIRDSYLEMALLYFHLKKPKIKISGSPLTLKPPLRRSSSVKETSANKFEMYSSLAWIAIRAAAQVSEAVLAINLLIGKKNTRMHKVNQVALPNIPEFAALDLLSSYTDYLLGMFGCLHIMQKN

SEQ ID NO: 10040 - protein, 445 aa, Homo sapiens
MGESIPLAAPVPVEQAVLETFFSHLGIFSYDKAKDNVEKEREANKSAGGSWLSLLAALAHLAAAEKVYHSLTYLGQKLGGQSFFSRKDSIRTIYTSLHNELKKVVTGRGALGGTAPHVEELLSHLSEQLCFFVQARMEMADFYEKMYTLSTQKFINAEELVGLLDAIMKKYSSRFHHPILSPLESSFQLEVDVLCHLLKAQAQVSEWKFLPSLVNLHSAHTKLQTWGQIFEKQRETKKHLFGGQSQKAVQPPHLFLWLMKLKNMLLAKFSFYFHEALSRQTTASEMKTLTAKANPDFFGKISSFIRKYDAANVSLIFDNRGSESFQGHGYHHPHSYREAPKGVDQYPAVVSLPSDRPVMHWPNVIMIMTDRTSDLNSLEKVVHFYDDKVQSTYFLTRPEPHFTIVIIFESKKSERDSHFISFLNEVSLALKNPKVFASLKPGAKG

SEQ ID NO: 10041 - protein, 343 aa, Homo sapiens
MALTPTNLNNKMSLQMKMDCQEQQLTKKNNGFFQKLNVTEGAMQDLLKEIIKVDHILDRSDDEDDISSENPQTDFLHKGMLELEAEHDQDLSKQDKQETDVDEDPQASTSLQFSKKNLLELCLKGMFLKLNYWNTKIGLQVKELGADYIDGTEKIDNIIKKINVTENTVKSLLKDMLTLKGQIEKLEDRGLDLDQGTSTEVNTCNEVYELKKKVIERLEDLCKNVELLSAKLRMYQMEAEDTDSHSSEEIDTEEMEALLPQAPASFLVQKSPPRNTAWKRALRIFIMFDVLTVTGLLCYILFFGATFLFERVLLRMLGCRTTWDLREMREPFLNLEVEALLPS

SEQ ID NO: 10042 - protein, 343 aa, Homo sapiens; identical to SEQ ID NO: 10041

SEQ ID NO: 10043 - protein, 301 aa, Homo sapiens
MAYSSSNSDIEDDSSKSNSNLSLSVGYFPCEDTPCEDTTSWEDAPSKGPSIHFLPPVQGAWGTERIGRRMKRQDQIQDEPEQFCKLSIFLAWDVDIGSDNTDSRANRLLNGDNLWIDKLPKERTKLSVGKLNNLVQEFQIFLENLKDDDAVFPETAQQDFQLSSGSPPEMVQVSHQEYDACQDLPKCKPPENKDVMLKGHELAEMISQATASQRTSAPEISSILSEQPEKDDTPSHTQAQCCLNFGWAFSWLRQRILPSLLRRDHPVNATKSPHRSAPTKRLFHRGKRIQPQETLELGHPI

SEQ ID NO: 10044 - protein, 269 aa, Homo sapiens
MAYSSSNSDIEDDSSKSNSNLSLSVGYFPCEDTPCEDTTSWEDAPSKGPSIHFLPPVQGAWGTERIGRRMKRQDQIQDEPEQFCKLSIFLAWDVDIGSDNTDSRANRLLNGDNLWIDKLPKERTKLSVGKLNNLVQEFQIFLENLKDDDAVFPETAQQDFQLSSGSPPEMVQMISQATASQRTSAPEISSILSEQPEKDDTPSHTQAQCCLNFGWAFSWLRQRILPSLLRRDHPVNATKSPHRSAPTKRLFHRGKRIQPQETLELGHPI

SEQ ID NO: 10045 - protein, 190 aa, Homo sapiens
MEKTESFCPEVPPQDCGASPRPSLRSLPKNQGSLLQFDRQAPGRISTSPTLRRLRTRGCGTRQDAWQVTTWGSWGAPVGFPCYLSKSLPGSPKDSSHLLSPLRLHSRLTSEPERALNAADSLEPQTRPTDKYLPPELQPVNEGSLHQASLRQQEGHFLPSPTLRHPSPQGEELHPSRCVCIYFLRCYDIC

SEQ ID NO: 10046 - protein, 173 aa, Homo sapiens
MEKTESFCPEVPPQDCGASPRPSLRSLPKNQGSLLQFDRQAPGRISTSPTLRRLRTRGCGTRQDAWQVTTWGSWGAPVGFPCYLSKSLPGSPKDSSHLLSPLRLHSRLTSEPERALNAADSLEPQTRPTDKYLPPELQPVNEGSLHQASLRQQEGHFLPSPTLRHPSPQVTQL

SEQ ID NO: 10047 - protein, 63 aa, Homo sapiens
MGCGNSTATSAGAGQGPAGAAKDVTEESVTEDDKRRNYGGVYVGLPSEAVNMVSSQTKTVRKN

SEQ ID NO: 10048 - protein, 135 aa, Homo sapiens
MFQNLQGTFEKEIGKIIPFTIAFKRAEAVEPDGCVQSWRCCLPCDLGQASRFIHTTVCSAIRWRSCKGERNFAERHILPAELEEQSNHAGMGPILPAMPSVDGNHFQHPAGDCHPYGILCLQAHSASVTARQVLQ

SEQ ID NO: 10049 - protein, 145 aa, Homo sapiens
MIPKLATPRDISLLVIKEASSRARNNIQILDPLDHIARLTNYTLTSCFSSNKVPTMPGSLPTGSKQGNVQTLDSIRWMPATPVPAPECHQKYAISTETAFPTLSTFMNTEKSVKGSNADFTKRNPRWRFLLGIYCSLHHAMTIFI

SEQ ID NO: 10050 - protein, 289 aa, Homo sapiens
MEQPGPRAPDPSLCHHNLQPTDDPNWDSYATTMRTAFTPKTGAVPALIRQNGIRRLGYTYSLSDPILNQTQYSDEYTWKSHSKEDLIKTETSRGIKSHKSHLNEDIFLWTLPHCQQTGTLKNCLPWKIPASMKEVNKALSNQFISLTKRDFVDRSKAQKIKKSSHLSLEWKKLLPQPPDTEFRRNYQIPAKIPELQDFSFKYGCYSSLPVASQGLVPSVLHSYLRNQEHTKKQTTYQSDYDKTYPDFLMLLNSFTSSQVKEYLQSLSYKDRQIIDRFIRTHCDTNKKKK

SEQ ID NO: 10051 - protein, 186 aa, Homo sapiens
MNLPHLMSLASHLASHGFFCLRFTCKGLNIVHRIKAYKSVLNYLKTSGEYKLAGVFLGGRSMGSRAAASVMCHIEPDDGDDFVRGLICISYPLHHPKQQHKLRDEDLFRLKEPVLFVSGSADEMCEKNLLEKVAQKMQAPHKIHWIEKANHSMAVKGRSTNDVFKEINTQILFWIQEITEMDKKCH

SEQ ID NO: 10052 - protein, 186 aa, Homo sapiens; identical to SEQ ID NO: 10051

SEQ ID NO: 10053 - protein, 227 aa, Homo sapiens
MSHTEVKLKIPFGNKLLDAVCLVPNKSLTYGIILTHGASGDMNLPHLMSLASHLASHGFFCLRFTCKGLNIVHRIKAYKSVLNYLKTSGEYKLAGVFLGGRSMGSRAAASVMCHIEPDDGDDFVRGLICISYPLHHPKQQHKLRDEDLFRLKEPVLFVSGSADEMCEKNLLEKVAQKMQAPHKIHWIEKANHSMAVKGRSTNDVFKEINTQILFWIQEITEMDKKCH

SEQ ID NO: 10054 - protein, 139 aa, Homo sapiens
MGQNWKRQQKLWNVPQLPFIRVPPSIYDTSLLKALNQGQQRYFYSIMRIYNSRPQWEALQTRYIHSLQHQQLLGYITQREALSYALVLRDSTKRASAKVAPQRTIPRKTSAMTRRCPSVLPVSVVLPRAQSKRRQVLRN

SEQ ID NO: 10055 - protein, 139 aa, Homo sapiens; identical to SEQ ID NO: 10054

SEQ ID NO: 10056 - protein, 303 aa, Homo sapiens
MAGAACEPVARPSLTSISSGELRSLWTCDCELALLPLAQLLRLQPGAFQLSGDQLVVARPGEPAAARGGFNVFGDGLVRLDGQLYRLSSYIKRYVELTNYCDYKDYRETILSKPMLFFINVQTKKDTSKERTYAFLVNTRHPKIRRQIEQGMDMVISSVIGESYRLQFDFQEAVKNFFPPGNEVVNGENLSFAYEFKADALFDFFYWFGLSNSVVKVNGKVLNLSSTSPEKKETIKLFLEKMSEPLIRRSSFSDRKFSVTSRGSIDDVFNCNLSPRSSLTEPLLAELPFPSVLESEETPNQFI

SEQ ID NO: 10057 - protein, 121 aa, Homo sapiens
MNSPEARLCVAQCRDSYPGCQPLKDTRAWASSLKMDPAGLEGGPRDESRDEPPIRAQAASWDQPQGCLTYKGRRSASGTQKQLQLPDTLSSLLCWRGAIMVYIKVTVQTDDSNKLLSLLYR

SEQ ID NO: 10058 - protein, 1164 aa, Homo sapiens
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFRTDKKPDPANWEYKSLYRGDIARYKRKGDSCLGINPKKQCISWEGTSTEKKHSRKQVERYFTKKSVGLMNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKKQTEEDCEDPERQVLFDDIGQSLIRLSSHDLQFQLVEAFLQFLGVPSGFTPPASCLYLAMDENSIFDNGLYDEKPLTFFNPLFSGASCVGRMDRLGYPRWTRGQNREGEEFIRNVFHLVMPLFSGKEKSQLCFSWLQYEIAKVIWCLHTKNKKRLKSQGKNCKKLAKNLLKEPENCNNFCLWKQYAHLEWLLGNTEDARKVFDTALGMAGSRELKDSDLCELSLLYAELEVELSPEVRRAATARAVHILTKLTESSPYGPYTGQVLAVHILKARKAYEHALQDCLGDSCVSNPAPTDSCSRLISLAKCFMLFQYLTIGIDAAVQIYEQVFAKLNSSVFPEGSGEGDSASSQSWTSVLEAITLMHTSLLRFHMKVSVYPLAPLREALSQALKLYPGNQVLWRSYVQIQNKSHSASKTRRFFDTITRSAKPLEPWLFAIEAEKLRKRLVETVQRLDGREIHATIPETGLMHRIQALFENAMRSDSGSQCPLLWRMYLNFLVSLGNKERSKGVFYKALQNCPWAKVLYLDAVEYFPDEMQEILDLMTEKELRVRLPLEELELLLED

SEQ ID NO: 10059 - protein, 933 aa, Homo sapiens
MNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKKQTEEDCEDPERQVLFDDIGQSLIRLSSHDLQFQLVEAFLQFLGVPSGFTPPASCLYLAMDENSIFDNGLYDEKPLTFFNPLFSGASCVGRMDRLGYPRWTRGQNREGEEFIRNVFHLVMPLFSGKEKSQLCFSWLQYEIAKVIWCLHTKNKKRLKSQGKNCKKLAKNLLKEPENCNNFCLWKQYAHLEWLLGNTEDARKVFDTALGMAGSRELKDSDLCELSLLYAELEVELSPEVRRAATARAVHILTKLTESSPYGPYTGQVLAVHILKARKAYEHALQDCLGDSCVSNPAPTDSCSRLISLAKCFMLFQYLTIGIDAAVQIYEQVFAKLNSSVFPEGSGEGDSASSQSWTSVLEAITLMHTSLLRFHMKVSVYPLAPLREALSQALKLYPGNQVLWRSYVQIQNKSHSASKTRRFFDTITRSAKPLEPWLFAIEAEKLRKRLVETVQRLDGREIHATIPETGLMHRIQALFENAMRSDSGSQCPLLWRMYLNFLVSLGNKERSKGVFYKALQNCPWAKVLYLDAVEYFPDEMQEILDLMTEKELRVRLPLEELELLLED

SEQ ID NO: 10060 - protein, 296 aa, Homo sapiens
MGLSHSKTHLRVIKVAPLQNKEVETPSAGRVDFAFNQNLEEKTSYSLARLQDQNKALEGQLPPLQENWYGRYSTASRDMYFDIPLEHRETSIIKRHPPQRLQKLEPIDLPRVITSGRLLSQREARTMHKAKQVLEKKMQTPMYTSENRQYLHKMQVLEMIRKRQEAQMELKKSLHGEARINKQSPRDHKAKKTLQSTPRNDDHDLLTMLPDEILNRGPGNSKNTEFLKHQAVNNYCPWKIGKMETWLHEQEAQGQLLWDSSSSDSDEQGKDEKKPRALVRTRTERIPLFDEFFDQE

SEQ ID NO: 10061 - protein, 482 aa, Homo sapiens
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIISDPRQKEKNKALASDFPHISACAHEFNPLSPLYSLDVLADASHRRCSPAHCSARQANVHWGPPCSRDIKRKRKPVATASLSSPSAVHMDAVEPTTPASQAPKSPSSEWLVRTSAAEKATDATTATFFKMPQEKSPGYS

SEQ ID NO: 10062 - protein, 477 aa, Homo sapiens
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIISDPRQKDFWLPSAGKRERNQFNPLSPLYSLDVLADASHRRCSPAHCSARQANVHWGPPCSRDIKRKRKPVATASLSSPSAVHMDAVEPTTPASQAPKSPSSEWLVRTSAAEKATDATTATFFKMPQEKSPGYS

SEQ ID NO: 10063 - protein, 447 aa, Homo sapiens
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKETSINTLGTERISHIITLGRKISGYHQLGKENEISSIPCLPFTPWMFLPMLLTEGVHQHTALPDRQMYTGDHHVHVTSRGSGNQWPQHLCLAPVQFTWMQWSQPHQHHKPPNHPALSGW

SEQ ID NO: 10064 - protein, 351 aa, Homo sapiens
MDELVHDLASALEQTSEQNKLGELWEEMALSPRQQRRQLRKRRGRKRRSDFTHLAEHTCCYSEASESSLDEATKDCREVAPVTNFSDSDDTMVAKRHPALNAIVKSKQHSWHESDSFTENAPCRPLRRRRKVKRVTSEVAASLQQKLKVSDWSYERGCRFKSAKKQRLSRWKENTPWTSSGHGLCESAENRTFLSKTGRKERMECETDEQKQGSDENMSECETSSVCSSSDTGLFTNDEGRQGDDEQSDWFYEGECVPGFTVPNLLPKWAPDHCSEVERMDSGLDKFSDSTFLLPSRPAQRGYHTRLNRLPGAAARCLRKGRRRLVGKVIPLTVSLAQWGDNIPYGSCVSY

SEQ ID NO: 10065 - protein, 351 aa, Homo sapiens; identical to SEQ ID NO: 10064

SEQ ID NO: 10066 - protein, 140 aa, Homo sapiens
MPLESSSSMPLSFPSLLPSVPHNTNPSPPLMSYITSQEMKCILHWFANWSGPQRERFLEDLVAKAVPEKLQPLLDSLEQLSVSGADRPPSIFECQLHLWDQWFRGWAEQERNEFVRQLEFSEPDFVAKFYQAVAATAGKD

SEQ ID NO: 10067 - protein, 140 aa, Homo sapiens; identical to SEQ ID NO: 10066

SEQ ID NO: 10068 - protein, 100 aa, Homo sapiens
MELLGEYVGQEGKPQKLRVSCEAPGDGDPFQGLLSGVAQMKDMVTELFDPLVQGEVQHRVAAAPDEDLDGDDEDDAEDENNIDNRTNFDGPSAKRPKTPS

SEQ ID NO: 10069 - protein, 354 aa, Homo sapiens
MESALAVPRLPPHDPGTPVLSVVDMHTGGEPLRIVLAGCPEVSGPTLLAKRRYMRQHLDHVRRRLMFEPRGHRDMYGAVLVPSELPDAHLGVLFLHNEGYSSMCGHAVLALGRFALDFGLVPAPPAGTREARVNIHCPCGLVTAFVACEDGRSHGPVRFHSVPAFVLATDLMVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVREAKCGDFKAVIVEVSGQAHYTGTASFIIEDDDPLRDGFLLK

SEQ ID NO: 10070 - protein, 88 aa, Homo sapiens
MASCTNRGGLPEKHSSSKVSSHAQMIQKAVDFLDLLIGHLSKFSPVLIVFQFSPLGFLVRQSSADNVQFLSFAPSLILPSGTGNWLVW

SEQ ID NO: 10071 - protein, 300 aa, Homo sapiens
MDWFHCNQCFRKDGAHFFVTSCGHIFCKKCVTLEKCAVCGTACKHLALSDNLKPQEKMFFKSPVETALQYFSHISQVWSFQKKQTDLLIAFYKHRITKLETAMQEAQQALVSQDKELSVLRKENGELKKFLAILKESPSRYQGSRSITPRPVGITSPSQSVTPRPSFQHSSQVVSRSSSAESIPYREAGFGSLGQGGRGLQGRRTPRDSYNETPSPASTHSLSYRTSSASSGQGIFSFRPSPNGHSGHTRVLTPNNFAQRESTTTLESLPSFQLPVLQTLYQQRRHMGLPSGREAWTTSR

SEQ ID NO: 10072 - protein, 154 aa, Homo sapiens
MLYCEAESPPTVEKVKPARENSETDLEIEGEHGHLGAVRAASPQKLEKSGFQELSSHSFPESALRMACGGNVAERPARFCLESSSGLAGESSCSFPRLSPASGAVPSRRLVKSGINTQTRFSNLLNVSTWGILCNLCNSPRSFPKKGSTEREHL

SEQ ID NO: 10073 - protein, 488 aa, Homo sapiens
MHIQFPSKPTLPRACWEGRITAGSPGMPPDEIEIEPVRQSSDKMLYCEAESPPTVEKVKPARENSETDLEIEDDEKFFTTGQKELYLEACKLMGVVPVSYFIRNMEESYVNLNHHGLGPRGTKAIAIALVSNMAVTKLELEDNCIMEEGVLSLVEMLQENYYLQEMNISNNHLGLEGARIISDFFERNSSSIWSLELSGNDFKEDSAALLCQALSTNYQIKKLDLSHNQFSDVGGEHLGQMLAINVGLTSLDLSWNNFHTRGAVALCNGLRGNVTLTKLDLSMNGFGNEVALALGEVLRLNRCLVYLDIGGNDIGNEGASKISKGLESNESLRVLKLFLNPINMDGAILLILAIKRNPKSRMEELDISNVLVSEQFMKTLDGVYAVHPQLDVVFKAVQGLSPKKTIFLLTNPMKLIQSYADQHKITIVDFFKSLNPTGTMKMSVDEFQKVMIEQNKVPLNQYQVREVIKKLDEKTGMVNFSFLNTMKP

SEQ ID NO: 10074 - protein, 186 aa, Homo sapiens [sequence omitted]

SEQ ID NO: 10075 - protein, 217 aa, Homo sapiens
MEDRAGEQEQERHSLRLEKLQHWARHRQSGHLLVLAVSQLWLAVVVVPLAVSVACLNSDCHMATALPLGPGASGLLTGTVTLELRRAPRLWKVRAMMIFNTFNLILGFIVVVVEVMKTALGPAPTASSQHAGLLVLELSAEAFTLGGVLVSVHALFLLSQRKPGCCRSQSLHYQELQEGFSELEEVPGLENGPTVASTGANERVGQREQTRAALLPP

SEQ ID NO: 10076 - protein, 217 aa, Homo sapiens; identical to SEQ ID NO: 10075

SEQ ID NO: 10077 - protein, 125 aa, Homo sapiens
MHRKEPGARLEATRGAARPHKQGTKPMITRPSVSQLGEGKCPSSQHLQSLRHNKQHALTLTKARCCGECSTCFCTEEKSECQRHEETSPGSCNHQIMSASTISAFCATPRFKQLFKGTVEQMSQM

SEQ ID NO: 10078 - protein, 75 aa, Homo sapiens
MHRKEPGARLEATRGAARPHKQGTKPMITRPSVSQLGEGKCPSSQHLQSLRHNKQHALTLTKARCCGECSTCFCT

SEQ ID NO: 10079 - protein, 122 aa, Homo sapiens
MGREMKKTGTPRPFRIEDPNQQPTWHDQPEMGSHYFAQAGLELLGSSNPPASASQSAGITGVSHCARPGEHDLNHTVFQVKDSTFLRHLESDRPEFKSCLPPHFTEPSVSLSTSEGCEDAMG

SEQ ID NO: 10080 - protein, 92 aa, Homo sapiens
MGSHYFAQAGLELLGSSNPPASASQSAGITGVSHCARPGEHDLNHTVFQVKDSTFLRHLESDRPEFKSCLPPHFTEPSVSLSTSEGCEDAMG

SEQ ID NO: 10081 - protein, 37 aa, Homo sapiens
MGREMKKTGTPRPFRIEDPNQQPTWHDQPGTESVFWL

SEQ ID NO: 10082 - protein, 107 aa, Homo sapiens
MTGRMATLEKSHSSACWRKRSSRTCVEPDRTQDAIHEPRGLSRSHTVLRHRHFVFLPLSSGAHPSVPPRRKNCAMKNGKLLRSCSSVRRAADKLDWGRFFLQDLQSV

SEQ ID NO: 10083 - protein, 636 aa, Homo sapiens
MGQGPRSPHKVGRRFPAGGKRGRGAKGSGRPLPGRKRQPWPPPDGRSEPAPDSHPHLSPEALGYFRRALSALKEAPETGEERDLMVHNIMKEVETQALALSTNRTGSEMLQELLGFSPLKPLCRVWAALRSNLRTVACHRCGVHVLQSALLQLPRLLGSAAEEEEEEEEDGKDGPTETLEELVLGLAAEVCDDFLVYCGDTHGSFVVRTLLQVLGGTILESERARPRGSQSSEAQKTPAQECKPADFEVPETFLNRLQDLSSSFLKDIAVFITDKISSFCLQVALQVLHRKLPQFCAHLCNAVIGYLSTRGSSVDGSPLLLFLRDQTSSRLLEQVLLVLEPPRLQSLFEEHLQGQLQTLAAHPIANFPLQRLLDAVTTPELLSPVFEELSPVLEAVLAQGHPGVVIALVGACRRVGAYQAKVLQLLLEAFHCAEPSSRQVACVPLFATLMAYEVYYGLTEEEGAVPAEHQVAMAAARALGDVTVLGSLLLQHLLHFSTPGLVLRSLGALTGPQLLSLAQSPAGSHVLDAILTSPSVTRKLRRRVLQNLKGQYVALACSRHGSRVLDAIWSGAALRARKEIAAELGEQNQELIRDPFGHHVARNVALTTFLKRREAWEQQQGAVAKRRRALNSILED

SEQ ID NO: 10084 - protein, 187 aa, Homo sapiens
MAYEVYYGLTEEEGAVPAEHQVAMAAARALGDVTVLGSLLLQHLLHFSTPGLVLRSLGALTGPQLLSLAQSPAGSHVLDAILTSPSVTRKLRRRVLQNLKGQYVALACSRHGSRVLDAIWSGAALRARKEIAAELGEQNQELIRDPFGHHVARNVALTTFLKRREAWEQQQGAVAKRRRALNSILED

SEQ ID NO: 10085 - protein, 167 aa, Homo sapiens
MELSSMKICAAIPTSRALPEVVRRMPRKRISGLEWLLQQDPGFSLVNTVKAGMIISFPSNNIYSSVCCCQSEIFKYEFSNSKKSSWIQEERHLGKNNVLYSAHDVSPEKVTSALKKTNKQTTTINNFPLQYLPGSKLLDRFLSLSRSLLCLNSWSSSLPLAPQVKKK

SEQ ID NO: 10086 - protein, 310 aa, Homo sapiens
MKTLFEEIKASIKNNYNQDRSFCRPVLPWGGVFTIKAGRKAVSCTPLYVEIRLKNTCTIDGFLMLLYVILNENENFPRELSLHFGREFVDCFLYLMDTYSFTTVKLLWIWDKMEKQQYKSEVHKASLIIDLFGNEHDNFTKNLENLMSTIQESYCSNWRCPTRVQEDQQRTININPPQEIPHGNLIRLAVNELFCSKIELCEEHGCGGLREFSQRIFCHGAPPFVVLNMQHWKSEDLAYVPYYLDLSDHKYLLEGATLFNKEEHHYSAAFQIGGHWMHYDGLRNVNLILLNKPPEFLLLSSLVYIRATEK

SEQ ID NO: 10087 - protein, 828 aa, Homo sapiens
MALSPWTPGLGAGEKLVQAAAVSTGPSLELCTLPSTLGSSVAVEALEQLFVVEQSLQSDYFKCNEEAKIFLKDIAVAVKKLEEMRKATIDLLEIESMELNKLYYLLETLPNSIKRELEECVRDARRLNLFEINTIKMRITRTENEIELLKKKITDLTKYNEALGEKQEELARKHARFVLSLNQTMEKKATTTVYINETYTKINLKREDIALQKKCIQEAEELMEKERAEYLIRKQELTAQINEFENTREVKRMETYQKKKELDKLQTKMSKIKETVTVSAAVLSDHNLEIARLHESIRYWEQEVSELKKDLAILEAKLCFFTDNKEKLDDISNDEKNEFLNKIKQLVETLHAARMEYKDLREKMKTLARQYKIVLSEEEKAFLQKQKIHDENQKQLTFISQKEYFLSQKRVDIKNMEEGLITLQELQQATKTVYQQQIKILSANLERESQRCVITQWKMACLRKKHARWTAKIKAEIQAITEKIQNAEVRRIELLNETSFRQQEISGFVAQIEKLTTELKEEEKAFVNKEKMLMKELSKYEEIFVKETQINKEKEEELVEYLPQLQVAEQEYKEKRRKLEELSNIITAQRQEEDLLNNHIFLFTRDFSRYISNMEDVKQELQQLRDQESKKNKDHFETLKNLENGFYINDQKADLLLLENKKLKEYILYLKNNIEKYREGQEALMHTSSDLSRQLIAQEAQYKDLWAEFQTTVKILVDNGEETLQDINNLTDKLRERDEKMQHVSTWLRGSLEGLRLLVEQESPMDLLSKQQLRALLVTSKEEKTCQLSDLVIPNYATNIQLNIDTYLGLNTLVVLSNSAFHLREFSR

SEQ ID NO: 10088 - protein, 793 aa, Homo sapiens
MALSPWTPGLGAGEKLVQAAAVSTGPSLELCTLPSTLGSSVAVEALEQLFVVEQSLQSDYFKCNEEAKIFLKDIAVAVKKLEEMRKATIDLLEIESMELNKLYYLLETLPNSIKRELEECVRDARRLNLFEINTIKMRITRTENEIELLKKKITDLTKYNEALGEKQEELARKHARFVLSLNQTMEKKATTTVYINETYTKINLKREDIALQKKCIQEAEELMEKERAEYLIRKQELTAQINEFENTREVKRMETYQKKKELDKLQTKMSKIKETVTVSAAVLSDHNLEIARLHESIRYWEQEVSELKKDLAILEAKLCFFTDNKEKLDDISNDEKNEFLNKIKQLVETLHAARMEYKDLREKMKTLARQYKIVLSEEEKAFLQKQKIHDENQKQLTFISQKEYFLSQKRVDIKNMEEGLITLQELQQATKTVYQQQIKILSANLERESQRCVITQWKMACLRKKHARWTAKIKAEIQAITEKIQNAEVRRIELLNETSFRQQEISGFVAQIEKLTTELKEEEKAFVNKEKMLMKELSKYEEIFVKETQINKEKEEELVEYLPQLQVAEQEYKEKRRKLEELSNIITAQRQEEDLLNNHIFLFTRDFSRYISNMEDVKQELQQLRDQESKKNKDHFETLKNLENGFYINDQKADLLLLENKKLKEYILYLKNNIEKYREGQEALMHTSSDLSRQLIAQEAQYKDLWAEFQTTVKILVDNGEETLQDINNLTDKLRERDEKMQHVSTWLRGSLEGLRLLVEQESPMDLLKKKKHIRTRVHFPVVKCTEKNTLTK

SEQ ID NO: 10089 - protein, 587 aa, Homo sapiens
MNDSLFVSLDRLLLEFVFQYEQDISTKEEMIQRINKCCEDIKENKVTICRIHETINATDEEIDHYCKHSEEIKDNCRNWKPTCDVFRKHEDYMQDQFTVYQGTVEKDKEMYHDYICQYKEVLKQYQLKYSETPFSREYYEKKREHEEIQSRVLACTEQLKMNETIFMKFRVPAPFPSLTKWTLNIVNLRCETQDILKHASNLTKSSSELKKEVDEMEIEINYLNQQISRHNETKALSETLEEKNKNTENRKELKERIFGKDEHVLTLNKTQSSQLFLPYESQKLVRPIKMHSSEPRVADIKEESSAKQSKLANIDFRQKENDTQIFNDSAVDNHSKCSHITTITSSQKFMQVRLLTPQKQSNSNQWSEKGDKDAEYGDKGTVRQVRESKCTSQAIYTEHFGKSVENDSDEVEERAENFPRTSEIPIFLGTPKAVKAPESLEKIKFPKTPPFEINRNRNAVPEVQTEKESPGLSFLMSYTSRSPGLNLFDSSVFDTEISSDQFNEHYSARNLNPLSSEQEIGNLLEKPEGEDGFTFSFPSDTSTHTFGAGKDDFSFPFSFGQGQNSIPSSSLKGFSSSSQNTTQFTFF

SEQ ID NO: 10090 - protein, 88 aa, Homo sapiens
MNDSLFVSLDRLLLEFVFQYEQDISTKEEMIQRINKCCEDIKENKVTICRIHETINATDEEIDHYCKHSEEIKDNCRNWKPTCDVFRK

SEQ ID NO: 10091 - protein, 529 aa, Homo sapiens
MPSKGKDKKKGKSKGKDTKKLIKTDESVVDRAKANASLWEARLEVTELSRIKYRDTSRILAKSNEDLKKKQCKMEKDIMSVLSYLKKQDQEKDNMIEKLKQQLNETKEKAQEEKDKLEQKYTRQINELEGQFHQKAKEIGMIHTELKAVRQFQKRKIQVERELDDLKENLRNTERIHQETLRRLESRFFEEKHRLEQEAEKKIIMLAERAHHEAIVQLNDAGRNVFKENDYLQKALAYHLKETDALQKNSQKLQESHTLLLHQKEINDLLVKEKIMQLVQQRSQIQTLQKKVVNLETALSYMTKEFESEVLKLQQHAMIENQAGQVEIDKLQHLLQMKDREMNRVKKLAKNILDERTEVERFFLDALHQVKQQILISRKHYKQIAQAAFNLKMRAACTGRTEYPKIRTFDGREHSTNSVNQDLLEAEKWTHIEGNVDIGDLTWEQKEKVLRLLFAKMNGCPSRKYNQSSRPPVPDYVVSDSGETKEFGDESKLQDKIFITQQIAISDSSGEVVLPTIPKEPQESDTGTF

SEQ ID NO: 10092 - protein, 265 aa, Homo sapiens
MQLVQQRSQIQTLQKKVVNLETALSYMTKEFESEVLKLQQHAMIENQAGQVEIDKLQHLLQMKDREMNRVKKLAKNILDERTEVERFFLDALHQVKQQILISRKHYKQIAQAAFNLKMRAACTGRTEYPKIRTFDGREHSTNSVNQDLLEAEKWTHIEGNVDIGDLTWEQKEKVLRLLFAKMNGCPSRKYNQSSRPPVPDYVVSDSGETKEFGDESKLQDKIFITQQIAISDSSGEVVLPTIPKEPQESDTSTQKPSDENFSTSY

SEQ ID NO: 10093 - protein, 127 aa, Homo sapiens
MPTMWRMLHQALKLRRRTVLAGQEISYVLPVMFVVSEEDSNRDVFLVAGYRHLEFGERIAIWGSSMQHVERRRWPLDSIQKRMGQSFTGWAEEAAPGMKTKKEYAEIGVKPRQNACEMCPGMILSTT

SEQ ID NO: 10094 - protein, 325 aa, Homo sapiens
MQGRRELGGEPLSDLQEEAASASLRVAPERLSDDSLEWRRTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVERVHKLCNESRKLWRALQSIHTTSTSQRLWSESRCQENFFLVLGIDAAQKNLSGGQGHIMEDCDLKEPEGLLTVSSFCLQHCKALIQTKLSGPPGSKQGRLMTCSRFLKTPSCGGGQHITIPRKRMFTPRKLKLTLFNSDVC

SEQ ID NO: 10095 - protein, 354 aa, Homo sapiens
MSGQRGDWVQTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 10096 - protein, 352 aa, Homo sapiens
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 10097 - protein, 393 aa, Homo sapiens
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 10098 - protein, 426 aa, Homo sapiens
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 10099 - protein, 495 aa, Homo sapiens
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQVSGAGAAQNLDLAYPKCLHSFCTPGMGPRTFWNDLWLVCEQPGLLPGDWAAPLDPGGASACSLLSPFRALLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 10100 - protein, 352 aa, Homo sapiens; identical to SEQ ID NO: 10096

SEQ ID NO: 10101 - protein, 157 aa, Homo sapiens
MLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPE

SEQ ID NO: 10102 - protein, 80 aa, Homo sapiens
MSGQRGDWTSALWQLLFRVLSPLPAGNALASLALEVQARLVKSALCSQGYPRLALAQLPEDGSQGSRELLLALSWLLARG

SEQ ID NO: 10103 - protein, 110 aa, Homo sapiens
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPG

SEQ ID NO: 10104 - protein, 248 aa, Homo sapiens
MLAQARVPLGDEMTVCQIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 10105 - protein, 54 aa, Homo sapiens
MLAQARVPLGDEMTVCQCEALASPGPPAPHMEAEGPVDVRHVQWLMGKLRFRWR

SEQ ID NO: 10106 - protein, 198 aa, Homo sapiens
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDSDGELGSRYSSGYSSAEQVNQDVSRQLLQDGYHLDEIPDDEDLDLIPPKPMASSTCSCCWCCLGDSSSCTLQ

SEQ ID NO: 10107 - protein, 148 aa, Homo sapiens
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDRPFMYIPGPFSSEQYPFPGWLG

SEQ ID NO: 10108 - protein, 301 aa, Homo sapiens
MAQNVYGPGVRIGNWNEDVYLEEELMKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIILSVHRDATGQVLRYGQDFCLGITGGFDNKMLYLSSDHRTLLKSSKRSWLQEVYLTDEVSHVNCWQAAFPDPQLRLEYEGFPVPANAKILINHCHTNRGLAAHRHLFLSTYFGKEAEVVAHTYLDSHRVEKPRNHWMLVTGNPRDASSSMLDLPKPPTEDTRAMEQAMGLDTQ

SEQ ID NO: 10109 - protein, 199 aa, Homo sapiens
MKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIILSVHRDATGQVLRYGQDFCLGITGGFDNKMLYLSSDHRTLLKSSKRSWLQEVYLTDEVSHVNCWNMKASPSRQMLKFSSITVTQIGDWQPTGIFS

SEQ ID NO: 10110 - protein, 178 aa, Homo sapiens
MNKRTSVDASKEDLHPADPQSGEGVPPNRKNTKTSPRGEGTAPPFSARPCVWTLCEMLSILALVGVLHPFYRSNNQVYQKLKTHLRCQSSRVDGLMLKPTLLTPSQLKSPEGHLILPTFNHLVIRHILDPKQIFCVADVCTDCKFNCGSIERHQKRHLMRVSQDWEHLIRYRNQICLS

SEQ ID NO: 10111 - protein, 508 aa, Homo sapiens
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFDERVFKIWKTHFLSEASIALLHDSFWWWFLHKFRPDRENQDCLFDRISESYVTLFMSIPLSRKDAFFQIYPDCLAQAIYATFHEAFPESSYLFNDEFKEDLGNNIFLWCSGLKPQKGFWIHWKLKELSTTTIHGSKKAPAKSVKERIADSQEHISTSIDFNIIKILNNPRAYTLPISKEESRLSRLATKSHYSSTGPEFNRVLFNFGGQSPLILYYLKMHELAGISKAPKKTKIKLTKIFQEPLPAPTYRDVIKEAKRQFARNQKDFRILQAKATKKPHEVKQDFEKFLHKLRSEAEIERECVASLSSSSSSSPSSTDNYNFEEEEY

SEQ ID NO: 10112 - protein, 303 aa, Homo sapiens
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFDERVFKIWKTHFLSEASIALLHDSFWWWFLHKFRIYPDCLAQAIYATFHEAFPESSYLFNDEFKEDLGNNIFLWCSGLKPQKGFWIHWKLKELSTTTIHGSKKAPAKSVKERIADSQEHIST

SEQ ID NO: 10113 - protein, 182 aa, Homo sapiens
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFD

SEQ ID NO: 10114 - protein, 304 aa, Homo sapiens
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFDERVFKIWKTHFLSEASIALLHDSFWWWFLHKFRIYPDCLAQAIYATFHEAFPESSYLFNDEFKEDLGNNIFLWCSGLKPQKGFWIHWKLKELSTTTIHGSKKAPAKSVKERIADSQEHISTS

SEQ ID NO: 10115 - protein, 130 aa, Homo sapiens
MPRPASESWSPIQSRIPAYKAVSHLRLLPTANSPSGSNQPTNPNRAQHPEGPQSREGATSPVLASLEPPTPTDLPSARARPRVPAESGPGWLHKARRPTRGILRDVLRHRGVPAQPRPAPGAHQLSSPSS

SEQ ID NO: 10116 - protein, 226 aa, Homo sapiens
MSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWDD

SEQ ID NO: 10117 - protein, 1047 aa, Homo sapiens
MAEKRPLRTLGPVMYGKLPRLETDSGLEHSLPHSVGNQDPCTYKGSYFSCPMAGTPKAESEQLASWTPYPPLYSTGMAGPPLQADNLLTNCLFYRSPAEGPEKMQDSSPVELLPFSPQAHSYPGPPLAAPKPVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASRYTGPYPRNSKQAMSEGPSSPWTQLAQPLGPPCQDTGPTHYPPPHHPPPHPPQALPCPPACRHPEKQGSYSPALPLQPLGGHKGTGYQAGGLGSPYLRQQAAQAPYIPPLGLDAYPYPSAPLPAPSPGLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEGARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGDFDTEAGAVSSSEPTVARGEPESLALAQKSPAPKVRKPGRKPPTPGPEKAEAAAGEESCGASPTPATSASPPGPTLKARFRSLLETAWLNGLALPTWGHKSSRPDQPSPCPQLLDSQSHHL

SEQ ID NO: 10118 - protein, 1047 aa, Homo sapiens; identical to SEQ ID NO: 10117

SEQ ID NO: 10119 - protein, 445 aa, Homo sapiens
MDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGDFDTEAGAVSSSEPTVARGEPESLALAQKSPAPKVRKPGRKPPTPGPEKAEAAAGEESCGASPTPATSASPPGPTLKARFRSLLETAWLNGLALPTWGHKSSRPDQPSPCPQLLDSQSHHL

SEQ ID NO: 10120 - protein, 126 aa, Homo sapiens
MPKKAGATTKGKSQSKEPERPLPPLGPVAVDPKGCVTIAIHAKPGSKQNAVTDLTAEAVNVAIAAPPSEGEANAELCRYLSKVLELRKSDVVLDKGGKSREKVVKLLASTTPEEILEKLKKEAKKT

SEQ ID NO: 10121 - protein, 167 aa, Homo sapiens
MLRLRSGLRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKTGSCYIAQAGLELLASSDLPASASQSAGITGVSHHTQPALLLISL

SEQ ID NO: 10122 - protein, 153 aa, Homo sapiens
MLRLRSGLRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKGGKSREKVVKLLASTTPEEILEKLKKEAKKT

SEQ ID NO: 10123 - protein, 149 aa, Homo sapiens
MLRLRSGLRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKLCYSIPQQLEETQEGVSGIPDTPCHFL

SEQ ID NO: 10124 - protein, 183 aa, Homo sapiens
MARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 10125 - protein, 281 aa, Homo sapiens
MILTKAQYDEIAQCLVSVPPTRQSLRKLKQRFPSQSQATLLSIFSQEYQKHIKRTHAKHHTSEAIESYYQRYLNGVVKNGAAPVLLDLANEVDYAPSLMARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 10126 - protein, 183 aa, Homo sapiens; identical to SEQ ID NO: 10124

SEQ ID NO: 10127 - protein, 220 aa, Homo sapiens
MFQGQRGWFCGSVSQDLRQFWVAEGGTISDPRAADFLFSCDASHPDTLRIYQSLDYIEDNATVFHAYYLSAVANAKIKNSVALGHFILPPACLQKEIRRKIGSFIWEQDQHFLIEKHDEVTPNEIKTLRENSELATEHKKELSKSPEKHFIRTPVVEKQMYFPLQNYPVNNMVTGYISIDAMKKFLGELHDFIPGTSGYLAYHVQNEINMSAIKNKLKRK

SEQ ID NO: 10128 - protein, 518 aa, Homo sapiens
MPTVVVMDVSLSMTRPVSIEGSEEYQRKHLAAHGLTMLFEHMATNYKLEFTALVVFSSLWELMVPFTRDYNTLQEALSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 10129 - protein, 518 aa, Homo sapiens; identical to SEQ ID NO: 10128

SEQ ID NO: 10130 - protein, 461 aa, Homo sapiens
MPTESLCRRTVSGDGHGEALSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 10131 - protein, 439 aa, Homo sapiens
MDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 10132 - protein, 482 aa, Homo sapiens
MPTVVVMDVSLSMTRPVSIEGSEEYQRKHLAAHGLTMLFEHMATNYKLEFTALVVFSSLWELMVPFTRDYNTLQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 10133 - protein, 257 aa, Homo sapiens
MPLACEHPVGVSSSVGNAGRAGVGTQAWGTTERTQHPGPAQHCPCGLRVFVLQEKRVVSRNWARGTCGPRVTNEMLEDEDAEDHGGTFCLGELVELAVTMENKAEGKRIVSEKPTRARNQGIEGSPGGRVTRSPPTQVAISSDSARKGSWEPWSRPVGEPPEAGWDYAQWKQEREQIDLARLARHRDAQGDWRRPWDLDKAKSTLQDCSQLRGEGPARAGSRRGEPTPTSSLPSLALFIFHPLVLSFLCLLVSYFQS

SEQ ID NO: 10134 - protein, 324 aa, Homo sapiens
MRHREGSWEPWSRPVGEPPEAGWDYAQWKQEREQIDLARLARHRDAQGDWRRPWDLDKAKSTLQDCSQLRGEGPARAGSRRGPRSHQKLQPPPLLPDGKGRGGQASRPSVAPATGSKARGKERLTGRARRWDMKEDKEELEGQEGSQSTRETPSEEEQAQKQSGMEQGRLGSAPAASPALASPEGPKGESVASTASSVPCSPQEPDLAPLDLSLGGAGIPGPRESGCVLGLRPGAQESPVSWPEGSKQQPLGWSNHQAELEVQTCPEPQRGAGLPEPGEDRSGKSGAQQGLAPRSRPTRGGSQRSRGTAGVRRRTGRPGPAGRC

SEQ ID NO: 10135 - protein, 534 aa, Homo sapiens
MISCAEQRSRQGEAGRGPAPVAPAFLPLWLPRGCSGILSVPAVAMHSAGTPRAESPMSRQEKDAELDRRIVALRKKNQALLRRYQEIQEDRRQAEQGGMAVTTPALLQPDGLTVTISQVPGEKRVVSRNWARGTCGPRVTNEMLEDEDAEDHGGTFCLGELVELAVTMENKAEGKRIVSEKPTRARNQGIEGSPGGRVTRSPPTQVAISSDSARKGSWEPWSRPVGEPPEAGWDYAQWKQEREQIDLARLARHRDAQGDWRRPWDLDKAKSTLQDCSQLRGEGPARAGSRRGPRSHQKLQPPPLLPDGKGRGGQASRPSVAPATGSKARGKERLTGRARRWDMKEDKEELEGQEGSQSTRETPSEEEQAQKQSGMEQGRLGSAPAASPALASPEGPKGESVASTASSVPCSPQEPDLAPLDLSLGGAGIPGPRESGCVLGLRPGAQESPVSWPEGSKQQPLGWSNHQAELEVQTCPEPQRGAGLPEPGEDRSGKSGAQQGLAPRSRPTRGGSQRSRGTAGVRRRTGRPGPAGRC

SEQ ID NO: 10136 - protein, 179 aa, Homo sapiens
MELQGAQEDLGISLSSPRRNHETRPGSKAKGRSSICLQASVWMAGGKLRLRASEHLTQGHQQELRDWNLGEDASLLFSKSPFGAGKLIQAPAHVFRQCWVQGNAWISCITKFDSKRSPEVASSPSYLTVPRRSPLPVFLRPSDRCVCGGCYLGKSTRRRACQSLLSDPLGVTFPTQTRP

SEQ ID NO: 10137 - protein, 183 aa, Homo sapiens
MEVKFITGKHGGRRPQRAEPQRICRALWLTPWPSLILKLLSWIILSNLFLHLRATHHMTELPLRFLYIALSEMTFREQTSHQIIQQMSLSNKLEQNQLYGEVINKETDNPVISSGLTLLFAQKPQSPGWKNMSSTKRVCTILADSCRAQAHAADRGERGHFGVQILHHFIEVFNVMAVRSNPF

SEQ ID NO: 10138 - protein, 183 aa, Homo sapiens; identical to SEQ ID NO: 10137

SEQ ID NO: 10139 - protein, 161 aa, Homo sapiens
MPRAGRAPAEGGPAPGTRSSRCLRPRPLAWRRLVPNFGAWAPRKGAARVGRPVLSPRTSGAAGEPTCGAGSPGTLEEGVASGRTRRRTQSAGEVAKCRWGLGQEPLCPRGAVLLNSFSPPAWPQFPPALRLRALAWPQPRGPACGSTAQWPPRGDPTWRIS

SEQ ID NO: 10140 - protein, 185 aa, Homo sapiens
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVAEDEPAAGDKPAAAEQ

SEQ ID NO: 10141 - protein, 185 aa, Homo sapiens; identical to SEQ ID NO: 10140

SEQ ID NO: 10142 - protein, 194 aa, Homo sapiens
MRGSGLRFQMKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVAEDEPAAGDKPAAAEQ

SEQ ID NO: 10143 - protein, 134 aa, Homo sapiens
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDER

SEQ ID NO: 10144 - protein, 170 aa, Homo sapiens
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVA

SEQ ID NO: 10145 - protein, 293 aa, Homo sapiens
MNIRGAPDLGQPSDDPSSGGERERIRQRMKMVIGQLEGILRELKEVAKELREVVSQIDKLTSDFDFELEPDDWTTATVSSTSSSDKAGMGGPFDLGHLDFMTADILSDSWEFCSFLDVSTPSDSVDGPESTRPGAGPDYRLMNGGTPIPNGPRVETPDSSSEEAFGAGPTVKSQLPQRTPGTRERVRFSDKVLYHALCCDDEEGDGEQEVEEEEVGLPPEPAHTEAHAGPHKPSPAPYKSRRSPLTSRHSGSTLAPEQTRRVTRNSSTQTVSDKSTQTVLPYTATRQKARGKN

SEQ ID NO: 10146 - protein, 293 aa, Homo sapiens; identical to SEQ ID NO: 10145

SEQ ID NO: 10147 - protein, 266 aa, Homo sapiens
MAEAGKVPLSLGLTGGEAAEWPLQRYARCIPSNTRDPPGPCLEAGTAPCPTWKVFDSNEESGYLVLTIVISGHFFIFQGQTLLEGFSLIGSKDWLKIVRRVDCLLFGTTIKDKSRLFRVQFSGESKEQALEHCCSCVQKLAQYITVQVPDGNIQELQLIPGPPRATESQGKDSAKSVPRQPGSHQHSEQQQVCVTAGTGAPDGRTSLTQLAQTLLASEELPHVYEQSAWGAEELGPFLRLCLMDQNFPAFVEEVEKELKKLAGLRN

SEQ ID NO: 10148 - protein, 129 aa, Homo sapiens
MRRRGEIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 10149 - protein, 129 aa, Homo sapiens; identical to SEQ ID NO: 10148

SEQ ID NO: 10150 - protein, 571 aa, Homo sapiens
MSREAGSCRVGTGARARSRKPKKPHYIPRPWGKPYNYKCFQCPFTCLEKSHLYNHMKYSLCKDSLSLLLDSPDWACRRGSTTPRPHAPTPDRPGESDPGRQPQGARPTGAAPAPDLVVADIHSLHCGGGPKSRAKGSPGPPPPVARATRKGPGPSGLLPESWKPGMGGDPRGVGAGDMASAGPEGSVPCYPPPAPGEFPEAHSLHLSLLGVNYPLSPGLFSYLGPSLAAAAHVPFLASASPLLPPATAFPAVQPPQRPTPAPRLYYPLLLEHTLGLPAGKAALAKAPVSPRSPSGTPAPGLLKVPVPGLGPWPRVTPRDPGQEGELERAAQSDPRRRLSLGSRLELPKASPSLTRFCSRSSLPTGSSVMLWPEDGDPGGPETPGPEGPLPLQPRGPVPGSPEHVGEDLTRALGDYARVEQRLGQLGPAGGLAPRPLREQLGKIRLELLTIHQALEQAVRPPDAPLDLSVKRAPAKGPQALGEAWGRPELGPVLTGGTPEPPGMLGPAAPQPFSGHTTKCEADSSVPPPGLPLAAPDDPVIPGSGWGTCVATRSSQTPEAVCGLQSPQGAEV

SEQ ID NO: 10151 - protein, 204 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGPYAINGKISPQSNVDFDLMLRCRNPEWGLRDTALLEDLGKASGLLLERMVDMPANNKCLIFRKN

SEQ ID NO: 10152 - protein, 107 aa, Homo sapiens
MLVAAAAERNKDPILHVLRQYLDPAQRGVRVLEVASGSGQHAAHFARAFPLAEWQPSDVDQRCLDRNPEWGLRDTALLEDLGKASGLLLERMVDMPANNKCLIFRKN

SEQ ID NO: 10153 - protein, 127 aa, Homo sapiens
MLVAAAAERNKDPILHVLRQYLDPAQRGVRVLEVASGSGQHAAHFARAFPLAEWQPSDVDQRCLDRGSSEQQDTCSNPGPCSSPTGNPEWGLRDTALLEDLGKASGLLLERMVDMPANNKCLIFRKN

SEQ ID NO: 10154 - protein, 185 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEEPRMGASGHSPPGGPGKGQWPAPGEDGGHASQQQMPDLPEKLSPSFTPAHLHPCRRLCEARTLPP

SEQ ID NO: 10155 - protein, 205 aa, Homo sapiens
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGEPRMGASGHSPPGGPGKGQWPAPGEDGGHASQQQMPDLPEKLSPSFTPAHLHPCRRLCEARTLPP

SEQ ID NO: 10156 - protein, 312 aa, Homo sapiens
MGRRRAARGPGAEGGRPRHLPTRSLEAFAEEVGAALQASVEPGAADGEGGPGPAALPCTLAMWELGHCDPRRCTGRKLARLGLVRCLRLGHRFGGLVLSPVGKQYASPADRQLVAQSGVAVIDCSWARLDETPFGKMRGSHLRLLPYLVAANPVNYGRPYRLSCVEAFAATFCIVGFPDLAVILLRKFKWGKGFLDLNRQLLDKYAACGSPEEVLQAEQEFLANAKESPQEEEIDPFDVDSGREFGNPNRPVASTRLPSDTDDSDASEDPGPGAERGGASSSCCEEEQTQGRGAEARAPAEVWKGIKKRQRD

SEQ ID NO: 10157 - protein, 204 aa, Homo sapiens
MELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 10158 - protein, 187 aa, Homo sapiens
MWGDLTETGCMGRRSAKKDQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 10159 - protein, 395 aa, Homo sapiens
MDLCQKNETDLENAENNEIQFTEETEPTYTCPDGKSEKNHVYCLLDVSDITLEQDEKAKEFIIGTGWEEAVQGWGRTSPAACIWPRKIPKKARVGEGACSDCLVCVNLSHWSLQTKPPTEGGPEKDQSSPSQTQAAPQGPSTASRAISDICFPTYFRAEKKSLQIKEFIWCNKDWAIPGTNRGKASGNPSGGAHRGLSIPGPLTSRALLVLPPLKASLSNALDVLGKKSKNSFLQSEEKVLDVEKDGCVAYAYGLKTADGKGEKRASELAKHPMVNDTPSSPSPAAQISLLTDPEQRCLHWSLLSEKNLACPPDPSNVRYLAALQLLQKRGVQSYKSKFKAKEPRSPVITRKHVLPKAKQENRPQMLETKVFPRPVLPSLTVSRVIIPVSTHRIL

SEQ ID NO: 10160 - protein, 388 aa, Homo sapiens
MDLCQKNETDLENAENNEIQFTEETEPTYTCPDGKSEKNHVYCLLDVSDITLEQDEKAKEFIIGTGWEEAVQGWGRTSPAACIWPRKIPKKARVGEGACSDCLVCVNLSHWSLQTKPPTEGGPEKDQSSPSQTQAAPQGPSTASRAISDICFPTYFRAEKKSLQIKEFIWCNKDWAIPGTNRGKASGNPSGGAHRGLSIPGPLTSRALLVLPPLKASLSNALDVLGKKSKNSFLQSEEKVLDVEKDGCVAYAYGLKTADGKGEKRASELAKHPMVNDTPSSPSPAAQISLLTDPEQRCLHWSLLSEKNLACPPDPSNVRYLAALQLLQKRGVQSYKSKFKAKEPRSPVITRKHVLPKAKQENRPQMLETKVFPRPVLPSLTHRKKKIK

SEQ ID NO: 10161 - protein, 122 aa, Homo sapiens
MVNDTPSSPSPAAQISLLTDPEQRCLHWSLLSEKNLACPPDPSNVRYLAALQLLQKRGVQSYKSKFKAKEPRSPVITRKHVLPKAKQENRPQMLETKVFPRPVLPSLTVSRVIIPVSTHRIL

SEQ ID NO: 10162 - protein, 167 aa, Homo sapiens
MDKLTIISGCLFLAADIFAIASIANPDWINTGESAGALTVGLVRQCQTIHGRDRTCIPPRLPPEWVTTLFFIIMGIISLTVTCGLLVASHWRREATKYARWIAFTGMILFCMAALIFPIGFYINEVGGQPYKLPNNTVVGSSYVLFVLSIFFTIVGLLFAGKVCLPG

SEQ ID NO: 10163 - protein, 139 aa, Homo sapiens
MVTHAAGARTFCEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 10164 - protein, 140 aa, Homo sapiens
MGLSKSKEKPRKGEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 10165 - protein, 433 aa, Homo sapiens
MLPAGCSRRLVAELQGALDACAQRQLQLEQSLRVCRRLLHAWEPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLMAELLPLVSAAQPQGPPWLALCRAVHSLLCEGGARVLTILRDEPAV

SEQ ID NO: 10166 - protein, 79 aa, Homo sapiens
MHPDLSPHLHTEECNVLINLLKECHKNHNILKFFGYCNDVDRELRKCLKNEYVENRTKSREHGIAMRKKLFNPPEESEK

SEQ ID NO: 10167 - protein, 438 aa, Homo sapiens
MLLCPAQKTVFRLQLTTAAQCLWVYLRDKQVVVFLAYPTRAPGRNNGVTSLHWPDPTLSLSWTQEAYTEYLRSIHYISQVLLEEVETTKEAGETVPPDTSKMLKLAQQCLERAQSTAAKLGKTRLKPTMPAAAPIPQPAGRHRRVYSDEGGKLSPFLPPEIFQKLQGAESQSCKKELTPLEEASLQNQKLKAAYEARMARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQPGPWGLPHPWGTPHLDCQTRTARSRTWSSSWGRLSGRAGAVGYSRSPSCSS

SEQ ID NO: 10168 - protein, 631 aa, Homo sapiens
MAAAAGDGTVKPLQSAMKLANGAIELDTGNRPREAYTEYLRSIHYISQVLLEEVETTKEAGETVPPDTSKMLKLAQQCLERAQSTAAKLGKTRLKPTMPAAAPIPQPAGRHRRVYSDEGGKLSPFLPPEIFQKLQGAESQSCKKELTPLEEASLQNQKLKAAYEARMARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQPGPVGSPSPLGDTASGLPDKDSSFEDLEQFLGTSERQGRGRGVQPEPQLQQLKTAVEEIHNAVDRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPPPIAAAAIGADDLLPILSFVVLRSGLPQLVSECAALEEFIHEGYLIGEEGYCLTSLQSALSYVELLPRGGLAK

SEQ ID NO: 10169 - protein, 520 aa, Homo sapiens
MASNDKGMAPSLGSPWASQMGPWDAILKAVKDQLPSLDSDSPLSDYGEEELFIFQRNQTSLIPDLSEELAEDPADGDKSRAWVAAAEESLPEPVLVPAELATEPGCRQNTRTKDASSQEGRDPGRPFESSGEVSALLGMAEEPPRWLEGDLGSLSFNTKGSQGPPWDPQAEATLSCHEGDPKAEPLSTASQESVNRRALRQERRKMIETDILQKVTRDACGPTSSDKGGVKEAPCHAAESAPRSKMPLVEPPEGPPVLSLQQLEAWDLDDILQSLAGQEDNQGNRAPGTVWWAADHRQVQDRMVPSAHNRLMEQLALLCTTQSKASACARKVPADTPQDTKEADSGSRCASRKQGSQAGPGPQLAQGMRLNAESPTIFIDLRQMELPDHLSPESSSHSSSDSEEEEEEEMAALGDAEGASPSSLGLRTCTGKSQLLQQLRAFQKGTAQPELPASKGPAGGRAQAPEDTAGSRTGRKQHMKLCAKGQSAQARLPRGRPRALGDVPEPGAAREALMPPLEQL

SEQ ID NO: 10170 - protein, 275 aa, Homo sapiens
MPLVEPPEGPPVLSLQQLEAWDLDDILQSLAGQEDNQGNRAPGTVWWAADHRQVQDRMVPSAHNRLMEQLALLCTTQSKASACARKVPADTPQDTKEADSGSRCASRKQGSQAGPGPQLAQGMRLNAESPTIFIDLRQMELPDHLSPESSSHSSSDSEEEEEEEMAALGDAEGASPSSLGLRTCTGKSQLLQQLRAFQKGTAQPELPASKGPAGGRAQAPEDTAGSRTGRKQHMKLCAKGQSAQARLPRGRPRALGDVPEPGAAREALMPPLEQL

SEQ ID NO: 10171 - protein, 275 aa, Homo sapiens
MEERKEEGEAEIQEHGPEHWFSKWERQCLAEAEQDEQLPPELQEEAAAAAQPEHKQQKLWHLFQNSATAVAQLYKDRVCQQPGLSLWVPFQNAATAVTNLYKESVDTHQRSFDIGIQIGYQRRNKDVLAWVKKRRRTIRREDLISFLCGKVPPPRNSRAPPRLTVVSPNRATSTETSSSVETDLQPFREAIALHGLSGAMASISVRSSTPGSPTHVSSGSNASRRRNGLHDVDLNTFISEEMALHLDNGGTRKRTSAQCGDVITDSPTHKRNRMI

SEQ ID NO: 10172 - protein, 265 aa, Homo sapiens
MSEQQMDLKDLMPTKRKYMWKTAEDRRMSDLTCVLEWLERRQGKKKQAPEKQKPKVVTVLKRNKKKEEKKGKGLMTARGGNRRDTETSQQALGKRFRKDAASYRSLYGVEQKGKHLSMVPGSYIKDGPKKSDTDIKDAVDPESTQRPNPFRRQSIVLDPMLQEGTFNSQRATFIRDWSNKMPDMAYERKLKSLMEKSTEPKMETMRMLKPEEVLSCRYLRLSKENIRTLLKLCKDAGMNVDIHPHMVEEDIDAKKVFTGIPSMAL

SEQ ID NO: 10173 - protein, 228 aa, Homo sapiens
MEPASCCAERPKPGPTGVKTKPSCGGWRAVSLLLLLLLLVLAAVGVVAGGLLGSAQGPPKPRLQTLRMTLPSPHMPRPNQTILVDVARNAATITVTPPQSNHSWAVLFDGQSGCICYRPEEHQVCFLRLMEDSDRETLRLLVDTSKVQEAWVPSQDTHHTQELLAVQGSLEVDPAQAGALVQRLCMRTPIYWARRAEGPRRQRLIYLCIDICFPSNICVSVCFYYLPD

SEQ ID NO: 10174 - protein, 193 aa, Homo sapiens
MFKNTFQSGFLSILYSIGSKPLQIWDKKVRNGHIKRITDNDIQSLVLEIEGTNVSTTYITCPADPKKTLGIKLPFLVMIIKNLKKYFTFEVQVLDDKNVRRRFRASNYQSTTRVKPFICTMPMRLDDGWNQIQFNLLDFTRRAYGTNYIETLRVQIHANCRIRRVYFSDRLYSEDELPAEFKLYLPVQNKAKQ

SEQ ID NO: 10175 - protein, 147 aa, Homo sapiens
MIVSRYGLVGCDAGQVRPKVELSLPAFLALPKKEFKDKPEVEENNLIEEAVWQTSLKIPLPQAQVRERGGGSAGISAAHPSQLCTAGVRPSSALRASRPGWSLQTAALQEPTGADSFLPRSHKTAVDLHSARIPLYIHTKCLLMESV

SEQ ID NO: 10176 - protein, 317 aa, Homo sapiens
MASAGAERRPGVQEATVVGQGQLTEEPGSAQTSECPVAGDQFLVPAHEARGTQSEDQRPAGAASESELQEEGPKLGEERPKPHAGALEERGPRPVVSIVRPRHGPKRKPVKSLSLPGLRAHLKAEAELPPKLPLQEEEPEDSQSEPSPSAKQHKKAKKRKSLGAPVLHAVASMVSAPLETLRLERKAQRLRPLYQYVNYCNPELNQAGKGDGEAEVEAEAELAPVPEEGGVEQLQALLPLAGELGPGLALPCPSPLVTPTHALAPLGEEAGEEPGGLPSLGVSDHKAEVDKSTQVDIDKMLSVCTAPLVPPLSPQYK

SEQ ID NO: 10177 - protein, 154 aa, Homo sapiens
MSATRAKKVKMATKSCPECDQQVPVACKSCPCGYIFISRKLLNAKHSEKSPPSTENKHEAKRRRTERVRREKINSTVNKDLENRKRSRSNSHSDHIRRGRGRPKSASAKKHEEEREKQEKEIDIYANLSDEKAFVFSVALAEINRKIINQRLIL

SEQ ID NO: 10178 - protein, 93 aa, Homo sapiens
MSATRAKKVKMATKSCPECDQQVPVACKSCPCGYIFISRKLLNAKHSEKSPPSTEKQEKEIDIYANLSDEKAFVFSVALAEINRKIINQRLIL

SEQ ID NO: 10179 - protein, 191 aa, Homo sapiens
  MOD_RES (1)..(1): Any amino acid
XEQGPAAPKSWLLLPTTLALHGSLDAVSQAQGRPGHPDAPPNIYEGGLGSPQPQCPSAQGSKPKNFRLRHLRGLGLYLESHPPPTGQCESHWLGRLMAGGCLPQPEGTAWALDLPQGTLGPRNSLCSALLEARLPRDSLGSSASSSSMDPDKGALPQPSPSRLRPKRSWGTWEEAMCPLCKRTRSGALERP

SEQ ID NO: 10180 - protein, 331 aa, Homo sapiens
MLNRKTSHFLGMRVQSELEHLSELRREAGKDRSSVHGSAARTRASVRTQWTTAAAAKADEDPGANLFPPPLPRPRICMWKYLDVHSMHQLEKTTNAEMREVLAELLELGCPEQSLRDAITLDLFCHALIFCRQQGFSLEQTSAACALLQDLHKACIATPLGNVEECYRYFTSVLFCHGVRRPPFSIDLFKEEQLLALEDYVVNTYFRHFKLYKYVFTPQVRLDLSLTYMGLQPPKLWPESETEKEESKEMEEQAVTPQKEELETVAPPEPEPSHIHVLRAYIKTQVNKELEQLQGLVEERLKASEERLSSKLTALERPFQLPPGKGKSKTK

SEQ ID NO: 10181 - protein, 177 aa, Homo sapiens
MLNRKTSHFLGMRVQSELEHLSELRREAGKDRSSVHGSAARTRASVRTQWTTAAAAKADEDPGANLFPPPLPRPRICMWKYLDVHSMHQLEKTTNAEMREVLAELLELGCPEQSLRDAITLDLFCHALIFCRQQGFSLEQTSAACALLQDLHKACIGERGQLPGLSPREKRNRAWHK

SEQ ID NO: 10182 - protein, 239 aa, Homo sapiens
MRASRSPPSPRRCHHHHEATGAASGAAAGGPGAGCVGLCRLALTPSAQDGRNSTFQTYKKEVCLPRHSMHPGPWAICCECQTRFGGRLPVSRVEAALPYWVPLSLRPRKQSQKTVQFPIPQTAKMCPCLCHRFGGRLPMPRDQAVMPYWVPQVLRSQQQIVRRQQSLKGIQAPLLDACCWHNCWRICGDECLLSKFQQLQAPYQDQLPAPAARLLPLGLLTLLQAIPRVIMAIRQCFGV

SEQ ID NO: 10183 - protein, 1141 aa, Homo sapiens
MSFSLTFTELANIAIPQCGVLNFKALHLLLHGILEHIHMAELKKVLSGDEDFLQTSQVVIMPREGDAQPILNPMKRLSNVFDHVVSRLDKLENQLALLQDLPSTAQLLEASQGTARPVQDLWHLIKLRKMVEGHDEVMAKSMQTLQDLLTDLHALQVTITALRKEVDMLKNMLDKVHPERMDIFAEDFKIQNWKMVALQREVASLQNKFKTIPKTEDMVLWSGLHDAMFTSEIGSSPLDLWQSVEQLPEAALAQTTKYLEATRAIQVSEPVQNPQLLQTVWHYEVPELLPEGSSAQAVSLSRAQEPAQPPALTPESAPGCTTEFAPGPAPGTEPVPGLELGLELEPVPALGPVPGPSVTPGSLPAPWPVLGPVPAPGAQPPPLGDWPALPRRWPLPQGWPRVGSWPLWDLGVLRPTQPQPSRAPPPATEFGSLWPRPLQPYQSRQGEALQLAAVQVKGEENDVPSLRGLRERARKDGAPKDRTRKDGVPKDRGGKDVDPKDRAHKDDVPKDRGGKDVDPKDRAHKDDVPKDRGGKDGDPKDRVGKDGAPKEAQPKAPQSALHRLKTTAAIAAAAAAAYAAATSSAAQAAKVAAKFVKDAPATKMAAIATDTAAAGPLGVFADVLGAGPSRGATESQILGDDSEIYEILSPSYSAASIGPDPALSQAMVATKQAMSPEDKKRAVKYSMSHIAQIPVKHDSLKEEFAQLSCNLNQRLSYLANMGGPSSLGTTVDILQKKIGSLQKSRLKEEELERIWGNQIEMMKDRYITLDKAVENLQIRMDEFKTLQAQIKRLEMNKVNKSTMEEELREKADRSALAGKASRVDLETVALELNEMIQGILFKVTIHEDSWKKAMEELSKDVNTKLVHSDLDPLKKEMEEVWKIVRKLLIEGLRLDPDSAAGFRRKLFKRVKCISCDRPVEMMTGPQLITIRKAHLLSRLRPASANSCEYLQRQQMREQQWLQLQDLGIQEDCQQDWGDGPQNATSLKCKSCNLLTLYPYGDPHVIDYDSAEVDILGVDGILYKGRVNSQRGAQPLAVAKELAAVKAPSPPSQSLYDRVHSSALFGAICPPLCPRSSACSAASGPHLTMPARPPSLPPLLLLPPLIPSLRDPQQAPGSTRLSRAPHIESRVGRKPPEEPANP

SEQ ID NO: 10184 - protein, 164 aa, Homo sapiens
MASARGAKQSSPRVGTTRYTETSTVRVETSSHRVETSSRRVETSQRRSEGPSLSPSGKRLPRILEASSRHVESSSQRTETTSRHVRASSLRVETSLHCAESPTPRPSRPPARTKKRPDEMLLPKGHQGARALSQDRKASSCQPASQLPGGPIIFGFMETNHKSM

SEQ ID NO: 10185 - protein, 167 aa, Homo sapiens
MFDFSFPTPASAGTRMGPASCGGRSLHLPQLRFSRVDATAVTDVPFQRMHAPHRAPEVFCSRSSRGAGRGHPTPTPRVRWALAGNQPRCCAQLLSGRGGSGAQLRAGWVRGAAVGNLFILLLGKEDGEEEGTVLSYSSMVHISNITGIVGTTVSRTKPALVLMELTF

SEQ ID NO: 10186 - protein, 112 aa, Homo sapiens
MAHSAAAVPLGALEQCPIRVEHDRRRRQFTVRLNGCHDRAVLLYEYVGKRIVDLQHTEVPDAYRGRGIAKHLAKAALDFVVEEDLKAHLTCWYIQKYVKENPLPQYLERLQP

SEQ ID NO: 10187 - protein, 825 aa, Homo sapiens
MEVRRGDTCPRPHPSGLREEGLEPKVAFPGGANRCWNLGADAGSRLTDVFGSVMLTGSASFYDCYTSQSEDNVDLRQTYTPFSSTEYSSSVDSSLFCAPWSTYGDDIKQPSNSQISIKNRIQTERNDYGSETDLYGLVSNILEEQDKSQPYFAEGTCSSNLKSVWPMNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYNENVDYCRYPEYVHPNKAKLNKCSNFSVQDSKKLANGTPETPTVEADTYTKLFQVKPANQKKMEETIPDQQNFTFPKTTPHLTEKQFAKEAVFTADFGLTSEYGLKPHTACPANDFANVTEKQQFAKPDPPHSEYFKSVNLLSNSATSSGGINLNRPTWMNVQTKNNTPIPYRNQGNLMKLNSHLSAASKGSNHSSDFPQLSSTNLTPNSNLFQKYCQENPSAFSSFDFSYSGAERIQSVNHIEGLTKPGEENLFKLVTDKKIKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEKERKKTELALAKNYPGKKVSSTNNTPVPRLTSNPSRVDRLIVDELRELARVSCKNR

SEQ ID NO: 10188 - protein, 952 aa, Homo sapiens
MEVRRGDTCPRPHPSGLREEGLEPKVAFPGGANRCWNLGADAGSRLTDVFGSVMLTGSASFYDCYTSQSEDNVDLRQTYTPFSSTEYSSSVDSSLFCAPWSTYGDDIKQPSNSQISIKNRIQTERNDYGSETDLYGLVSNILEEQDKSQPYFAEGTCSSNLKSVWPMNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYNENVDYCRYPEYVHPNKAKLNKCSNFSVQDSKKLANGTPETPTVEADTYTKLFQVKPANQKKMEETIPDQQNFTFPKTTPHLTEKQFAKEAVFTADFGLTSEYGLKPHTACPANDFANVTEKQQFAKPDPPHSEYFKSVNLLSNSATSSGGINLNRPTWMNVQTKNNTPIPYRNQGNLMKLNSHLSAASKGSNHSSDFPQLSSTNLTPNSNLFQKYCQENPSAFSSFDFSYSGAERIQSVNHIEGLTKPGEENLFKLVTDKKIKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEKERKKTELALAKNYPGKKVSSTNNTPVPRLTSNPSRVDRLIVDELRELARVVTLLGKMERLRSSLLHASISTALDRHLESIHIVQSRRKDEIVNASNRQRQGVPRCQDDRDVFALASAIKEMCVATRKTRTALWCALQMTLPKTASTADVVKPLQDTVNCEDKVHESINSSNPMNQRGETNKH

SEQ ID NO: 10189 - protein, 659 aa, Homo sapiens
MNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYNENVDYCRYPEYVHPNKAKLNKCSNFSVQDSKKLANGTPETPTVEADTYTKLFQVKPANQKKMEETIPDQQNFTFPKTTPHLTEKQFAKEAVFTADFGLTSEYGLKPHTACPANDFANVTEKQQFAKPDPPHSEYFKSVNLLSNSATSSGGINLNRPTWMNVQTKNNTPIPYRNQGNLMKLNSHLSAASKGSNHSSDFPQLSSTNLTPNSNLFQKYCQENPSAFSSFDFSYSGAERIQSVNHIEGLTKPGEENLFKLVTDKKIKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEKERKKTELALAKNYPGKKVSSTNNTPVPRLTSNPSRVDRLIVDELRELARVSCKNR

SEQ ID NO: 10190 - protein, 163 aa, Homo sapiens
MNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYNENVDYCRYP

SEQ ID NO: 10191 - protein, 129 aa, Homo sapiens
MNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRI

SEQ ID NO: 10192 - protein, 164 aa, Homo sapiens
MNNSLDYLAYPVIVSNHRQSTTFRKKLDFGHYVSHKNRIQIAKPTVDTKPPVAHTNHILKLSKLQGEQKKINKIEYENKQLCQKIANAHRGPAKVDCWNEYFSKSLNRETRNRELVRITMENQGILKRLVDRKPHYDRRASEIDWQNSRRYIRNTTRYLLSQNE

SEQ ID NO: 10193 - protein, 190 aa, Homo sapiens
MKGTPSSLDTLMWIYHFHSSTEVALQPPLLSSLELSVAAAHEYLEQRFRELKSLEPPEPKMQGMLPAPKPTLGLVLREATASLVSFGTTLLEISALWLQQEARRLDGSAGPAPDGRDPGAALSRVAQAAGQGVRQAGAAVGASARLLVQGAWLCLCGRGLQGSASFLRQSQQQLGLGIPGEPVSSGHGVS

SEQ ID NO: 10194 - protein, 78 aa, Homo sapiens
MAPLPGAELVRRPLQLYRYLLRCCQQLPTKGIQQHYKHAVRQSFRVHSDEDNPERIQQIIKRAIEDADWIMNKYKKQN

SEQ ID NO: 10195 - protein, 62 aa, Homo sapiens
MDQLVFKETIWNDAFWQNPWDQGGLAVIILFITAVLLLILFAIVFGLLTSTENTQCEAGEEE

SEQ ID NO: 10196 - protein, 300 aa, Homo sapiens
MCARGQVGRGTQLRTGRPCSQVPGSRWRPERLLRRQRAGGRPSRPHPARARPGLSLPATLLGSRAAAAVPLPLPPALAPGDPAMPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWGKFLAFYQYAKSFNSDDFDYEELKNGDYVFMRWKEQFLVPDHTIKDISGASFAGFYYICFQKSAASIEGYYYHRSSEWYQSLNLTHVPEHSAPIYEFR

SEQ ID NO: 10197 - protein, 226 aa, Homo sapiens
MPVRTECPPPAGASAASAASLIPPPPINTQQPGVATSLLYSGSKFRGHQKSKGNSYDVEVVLQHVDTGNSYLCGYLKIKGLTEEYPTLTTFFEGEIISKKHPFLTRKWDADEDVDRKHWNIGRYLDLQTLLDWTETFWVREELRRPPLVLACEVWLSQGAEPMECFLLQQFVAAFVVLSISPNFHHSWRTPRFPRGTPGALYCTWVCLRFTMSNTLHLGCHFFIIN

SEQ ID NO: 10198 - protein, 384 aa, Homo sapiens
MGVTGAHGFPCCGKGSVEVAEMRDDLSQHQIQEEQELEADMLEQKPQLQVDLDLDPDPDPDPELEIGQVPALLESELYPALKLEAELDTEANSNEESDFEEPMQLVCKIESVHSNMGLPTPQTFRPWSLNSNCRSFTEENHVSACHHSISAQTSKHLFWANKLIQASEHSLQRAINMQLNNGSAGQPIRSPLREAIPTNALCSEEQLQIPDAHSAPPTTSSQAPSPLLSSDLPPPIDLTELITFASSLAMASSSRMDLPSLEHMMKAPPQEALEPSTEPLLTTVEEREPENHAETLPEKPREARAPLKSWSQEDKNFAQSYFDFSKPGIKRATIKGQIQLLQPPATSPLLQGSKEDSVPPGKEKENPLLVKIHFKLSAPTIPEK

SEQ ID NO: 10199 - protein, 363 aa, Homo sapiens
MRDDLSQHQIQEEQELEADMLEQKPQLQVDLDLDPDPDPDPELEIGQVPALLESELYPALKLEAELDTEANSNEESDFEEPMQLVCKIESVHSNMGLPTPQTFRPWSLNSNCRSFTEENHVSACHHSISAQTSKHLFWANKLIQASEHSLQRAINMQLNNGSAGQPIRSPLREAIPTNALCSEEQLQIPDAHSAPPTTSSQAPSPLLSSDLPPPIDLTELITFASSLAMASSSRMDLPSLEHMMKAPPQEALEPSTEPLLTTVEEREPENHAETLPEKPREARAPLKSWSQEDKNFAQSYFDFSKPGIKRATIKGQIQLLQPPATSPLLQGSKEDSVPPGKEKENPLLVKIHFKLSAPTIPEK

SEQ ID NO: 10200 - protein, 570 aa, Homo sapiens
MVKTNKPGAKVAVSAQRGSEVTTNTSPQQGHGYVLASSHRSAAVSLNPSHRRSEAAHPTTPHSASDYPRSVSLQSGPGHYAVPTPRGPETGPRTESSRHSSPHLKSQKTQTLASHASSRQWKVSPPREEAARRGSESKSGREVGHHASSIPDAKSTHQLSFQDQKNNLQSQILEDDPPSKVQNPQGVRVPRRILSYPKDEAVQTEPIQRITTTSEIRSPRSPSLLEHGSSCVSADYQTAQRRVPVEESETGPYGPIPSKPKALYRNMNLDSLLKLSVLKDSDGVHRVSARVDPESLHKYSAYPETKPSAKVLVSSQVESNVRTPIRGNSEVGRRVTISPGVQSVEPTHHVTVPSVSEGSHKSSMFVTPEPIYKQQTQKPPEITYMSQGPTPRYPELSQKPSIHAELELTPRPLPPRSLPRYGPDSSWWPLLNPEVETPQSQLTTPDFEPKCSPSLDLLLSGFKIDSSPFCEDLKFQREKASLSPPSPPKEFPSWAPLSEVPQTPKHTCKQPIQRFTAFFLDVSEEMYNRVIWWLKGLCFSLLWAHCGSLGDGRTGEEWHLCIYRAGSFRR

SEQ ID NO: 10201 - protein, 342 aa, Homo sapiens
MDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGLSEPQFVQFNGGFSQEQLNWLNEVLTFSDTNQEKVVIVSHLPIYPDASDNVCLAWNYRDALAVIWSHECVVCFFAGHTHDGGYSEDPFGVYHVNLEGVIETAPDSQAFGTVHVYPDKMMLKGRGRVPDRIMNYKKERAFHC

SEQ ID NO: 10202 - protein, 174 aa, Homo sapiens
MDKHGVKTPLWKKETEELRAEDAEQEEGKEGSEDEDEDNQRPLEDSATEGEEPPRVAEEGEGRERRSVSYCPLRQESSTQQVALLRRADSGFWGWLGPLALLGGLTAPTDRKRSLPEEPCVLEIRRRPPRRGGCACCELLFCKKCRSLHSHPAYVAHCVLDHPDLGKAGAAGNS

SEQ ID NO: 10203 - protein, 221 aa, Homo sapiens
MGEKSRRKGPAPRHADGKLGRTCDHPYAPWSFTPSSRAPTAWVRPPCPVWASRLQEHSPEPRRARAPPTRRAQAALYAPALRLRDHLDRFSILMTSCTSWLQAPQAPGLCRDEQSSRISVPQLSGAPILLPDLEGTKLSNFQESSPLPHKHERKDKRSTPEEEGRSAPEKIIQSLKLCPGGHRPASLSSGCPAGCRLSFNLPPSMLLSVQKCCMPSSLKTC

SEQ ID NO: 10204 - protein, 521 aa, Homo sapiens
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLRETARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQAALKQLPRNKVPNMAVMIKSLTRSTMDASVVFKDPTGEMQGTVHRLLLETCQNELKPGSVLLLKQIGVFSPSLRNHYLNVTPNNLVHIYSPDSGDGSFLKPSQPFPKMTWMDS

SEQ ID NO: 10205 - protein, 137 aa, Homo sapiens
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSNCLNSSHSATPLGSLSATLPCSSTSASPSC

SEQ ID NO: 10206 - protein, 647 aa, Homo sapiens
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLRETARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQQSGRSLEDIMVSAPQTPTHGALAKFQTEIVASSQASVEEDFGRGPWLTMKSTLGLDERDPSCFLCTYSIVMVLRKQAALKQLPRNKVPNMAVMIKSLTRSTMDASVVFKDPTGEMQGTVHRLLLETCQNELKPGSVLLLKQIGVFSPSLRNHYLNVTPNNLVHIYSPDSGDGSFLKPSQPFPKDSGSFQHDVAAKPEEGFRTAQNLEAEASPEEELPEADDLDGLLSELPEDFFCGTSS

SEQ ID NO: 10207 - protein, 973 aa, Homo sapiens
METKVHLFCQAEENIDLLDDGSNSFATDLSSGTINHKKYIKFSKTIEKEISPEIRSLSPEYKKIFETSIIFCGEEKSSDFSGEKKVGRKSLQVQQHSKRTEIIPPFLKLSKEKVTRKENSLCKLPNQYSVHKTSSPLCTSSAITREKEMLSNLYMTLYDEVTHGYLHSKELSALHKACKIFSKIRSGKIYVNDLPVILCILRISISDLEMRQALKTVDIDAFQDALKIFCRIKGGRVSTDDVFAVLDSMGIPINREILEEVTKHTYIDSNHMVDIGDIIFTLNELQEQYEDVSITEGSPLNEITSDRKLSSVAGCYLKYKKKNSLSSKLPEPSISKKLNKKSNQYYSKIMENDDLESKRPKNTWQIRKFLGGVGSSNVGVQEPYSKNGINFKKHSEKGEIHDSKSKPQSLKSSTSLSKSLDKSDISSIPKLQKPAVRKHSSLQKQVSSTEKTAISTLENFCEAISKLQENYIAAEELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKKVNFKEFIDTMMSNTECFSEKLVLPDAIETLDDLRKETMSVSDLWNTLSSLNSNLKKDEFLAALELVTVDEGDKVQFEEFAKVVRNMRDAARLEELQEVVLAADLLEGDMIAGKNLEDFLRNVGIKSPKEEVEKILQSDFVSEDNMVNIKDCMRALRDTQKFSNYIDFRKEASNLKLPKVNEIKEAANILSHVDNGKIGIPDLEHALKCLNVNLTEEDFNEALNCCNVSDNMEVDLKDFLMKMKESPHFQKSKATQILLATTQILQNDLVDVSDLKTLLMDKDLHTANAILTVMLRHVPEHESGKVSIQEFMTKLSDILTIPKAAGKFYLICTYCPDLERQAVVYMLKTIQDSIVKAQVSKKQYNMNIKQHKISLHNFCLNSKANIAKLNPNSKF

SEQ ID NO: 10208 - protein, 531 aa, Homo sapiens
METKVHLFCQAEENIDLLDDGSNSFATDLSSGTINHKKYIKFSKTIEKEISPEIRSLSPEYKKIFETSIIFCGEEKSSDFSGEKKVGRKSLQVQQHSKRTEIIPPFLKLSKEKVTRKENSLCKLPNQYSVHKTSSPLCTSSAITREKEMLSNLYMTLYDEVTHGYLHSKELSAFQDALKIFCRIKGGRVSTDDVFAVLDSMGIPINREILEEVTKHTYIDSNHMVDIGDIIFTLNELQEQYEDVSITEGSPLNEITSDRKLSSVAGCYLKYKKKNSLSSKLPEPSISKKLNKKSNQYYSKIMENDDLESKRPKNTWQIRKFLGGVGSSNVGVQEPYSKNGINFKKHSEKGEIHDSKSKPQSLKSSTSLSKSLDKSDISSIPKLQKPAVRKHSSLQKQVSSTEKTAISTLENFCEAISKLQENYIAAEELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKK

SEQ ID NO: 10209 - protein, 53 aa, Homo sapiens
METKVHLFCQAEENIDLLDDGSNSFATDLSSGTINHKKYIKFSKTIEKEISPE

SEQ ID NO: 10210 - protein, 37 aa, Homo sapiens
METKVHLFCQAEENIDLLDDGSNSFATDLSSGTINHK

SEQ ID NO: 10211 - protein, 75 aa, Homo sapiens
MNRLYLTPDGFFFRVHMLALDSSSCNKPCPEFKPGIETDLNDAAYVLYTTVCNVGATARAVGRPAFFWERWETMT

SEQ ID NO: 10212 - protein, 97 aa, Homo sapiens
MNRLYLTPDGFFFRVHMLALDSSSCNKPCPEFKPGSRYIVMGHIYHKRRQLPTALLQVLRGRLRPGDGLLRSSSSYVKRFNRKREGQIQGAIHTQCI

SEQ ID NO: 10213 - protein, 75 aa, Homo sapiens; identical to SEQ ID NO: 10211

SEQ ID NO: 10214 - protein, 75 aa, Homo sapiens; identical to SEQ ID NO: 10211

SEQ ID NO: 10215 - protein, 562 aa, Homo sapiens
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAPPNVTVSTSTIPLSMAATLQHSQPPDLSSIVHQINQFCQTRAGISTTSVCEGQIANPSPISRSLLINASTRVSTHSVPTPMPSCVVNPMEHTHAATAALPAAGPVNLPTGISRVPTGYPSDLKPVTWNQHQLAHLQQMCSEASGTPAPGLTGKHAAGRELAGPGFVGKAPAYPQELCLAQSFHLKPPLEKPTPSPPVNGMAAPLAYPNGHYFQPLWNNILPTPNSDSSGSQDLAMPFHGGQPTGAPLDCAAAPGAHYRAGTGGGPVASQNSLMQTVDYLSGDFQQACFREQSLAMLSKAHRAPGNRAPDPTESRSLHIQHPGYR

SEQ ID NO: 10216 - protein, 562 aa, Homo sapiens; identical to SEQ ID NO: 10215

SEQ ID NO: 10217 - protein, 236 aa, Homo sapiens
MEASDGQGGEGDKPLEQVTNVSCLETSSSASPARDSLMRHAKGLDQDTFKTCKEYLRPLKKFLRKLHLPRDLPQKKKLKYMKQSLVVLGDHINTFLQHYCQAWEIKHWRKMLWRFISLFSELEAKQLRRLYKYTKSSQPAKFLVTFCASDAPERSLLADREDSLPKLCHAWGLHSNISGMKERLSNMQTPGQGSPLPGQPRSQDHVKKDSLRELSQKPKLKRKRIKEAPETPETEP

SEQ ID NO: 10218 - protein, 193 aa, Homo sapiens
MSGPPSAPQGALAAPRSPAVRRKGLQAPSWGSPGRPAAHSPWACGPPHWGPQRGPRNAAAARPGPRSRWHKRCAAACGACARPPGHQLQPPGAGAPQPGVACSYLGPRPQRTPCSAQSRPGWCAGPRRRHAPGTEPHVAPGRAPPPRAGASPGSRLLPGSPSLLLPAATWRTWGQESKVLRKILKAWDPFSLL

SEQ ID NO: 10219 - protein, 570 aa, Homo sapiens
MAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVAQTGPEKVKYEAYRTLAILGCLNKHVIRALIKQLKEKNEGQRMETLTGLRMALNSWAAVSKDKRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLAVRQAVAQTVEELKLKPTMMNLVEAQLMNPDATARQEAVISLGVLGIRSPQVFHLLLDLLDAENHQAVKKSLQETLILCASIDPWIQNKLKNKVLSVYEAPKTNVKAEPTRFQKEPENPEELTIQDFRLAKLNPLFIAKSITKVGQKKTPAFPPCCSKPRKHRPQVIGPWQPRIKKQLRVLAEIAK

SEQ ID NO: 10220 - protein, 98 aa, Homo sapiens
MASGAGGSWGRSPPQSAVPTPWVTFLQPLSWAVPPAPPQPGRVKEDLLELMMLQNAQMHQLLLSRLVAGALQPRPASPCPQESCAPTPTPQCHRDCGC

SEQ ID NO: 10221 - protein, 189 aa, Homo sapiens
MASGAGGSWGRSPPQSAVPTPWVTFLQPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPRIQHCPASREREVRAVPPPPPPSATGTVGADVPPASDYYDAESLL

SEQ ID NO: 10222 - protein, 236 aa, Homo sapiens
MASGAGGSWGRSPPQSAVPTPWVTFLQPLSWAVPPAPPQPGRVKEDLLELMMLQNAQMHQLLLSRLVAGALQPRPASPCPQVYLEVPQEEPEEEEEEMDVREKGPLVFHHHYLPYLMPSPGALLPWPAPFFPTPACQPYLQDVPRIQHCPASRERETTMMPRASYEDRPRPWELHQLPALDTAPEPPPAPLLSTPRCPWLAVLLTPSTSARPSSPGEISPCPTPMSSWTGRICAVV

SEQ ID NO: 10223 - protein, 139 aa, Homo sapiens
MMLQNAQMHQLLLSRLVAGALQPRPASPCPQVYLEVPQEEPEEEEEEMDVREKGPLVFHHHYLPYLMPSPGALLPWPAPFFPTPACQPYLQDVPRIQHCPASREREVRAVPPPPPPSATGTVGADVPPASDYYDAESLL

SEQ ID NO: 10224 - protein, 98 aa, Homo sapiens; identical to SEQ ID NO: 10220

SEQ ID NO: 10225 - protein, 501 aa, Homo sapiens
MENQLWHNTVRCCNQYQESPHDAEDILLLLLGLIVLVNIGINVATMMWHGLQNALDKMIDWATQKNEIQASESPPSGPPDKAQDVHIHCILDPVQVKMSRPTQYSSFSCHHFSNHHSSSLLRCVRRRRRRHRRCRRRCCNHQQRPQNYRQIPHSHSVFRNPHRSQKMSQLHRVPFFDQEDPDSYLEEEDNLPFPYPKYPRRGWGGFYQRAGLPSNVGLWGHQGGILASLPPPSLYLSPELRCMPKRVEARSELRLQSYGRHGSQSRLWGNVEAEQWASSPPPPHRLPPNPSWVPVGHSPYPSVGWMLYDSWDQRRRGTEGFERPPASVSRNARPEAQGCREHHSPQSHQQSLLGHAYGQSHRSPHPSTEPLGYSSQDPREVRRRAADWAEALPAWRPLTTSASLTVLDEASHQRTPAPSSVLVPHSSQPWPKVQAADPAPPPTMFVPLSRNPGGNANYQVYDSLELKRQVQKSRARSSSLPPASTSTLRPSLHRSQTEKLN

SEQ ID NO: 10226 - protein, 396 aa, Homo sapiens [sequence omitted]

SEQ ID NO: 10227 - protein, 396 aa, Homo sapiens
MLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 10228 - protein, 243 aa, Homo sapiens
MDELALSFSLTCLLPENRASLSPSQPLSFQCLKAPATLTWEDEKQQRWGQPHGPVSSPLLGDHRCLVPFRDLNPSSEVNTANLLESPSSLLLTSCYICSYFSFYILGEKRCHSLKRLRYSVCCKVCPNFCACGKENVSGTGQVCTGVHVGAKEQEEPGGTQALRSCGIYCLEERTDKASHEECRERSTLGRPQCTGLTPSLAGESPCPRLLPGSPTVRHLIASSCPGLSDPLPLPPGTLPLGS

SEQ ID NO: 10229 - protein, 243 aa, Homo sapiens; identical to SEQ ID NO: 10228

SEQ ID NO: 10230 - protein, 38 aa, Homo sapiens
MDELALSFSLTCLLPENRASLSPSQPLSFQCLKAPATL

SEQ ID NO: 10231 - protein, 251 aa, Homo sapiens
MGRPLEGQPLRALDLYPEPAFLRSGKDPKSSPASSPSFAVLGPEVRSTGGQAGSRRRPSAPCSQDRAAAEGAPALLGGSPSSGSPGHPPGSAFGVEAGCRALNVSEHARGGFALGLPFGLSGGAYLFLLLDGAGDPKPTPEAPISSADGRAWFPSESSWQLPQLPAGSTSGSEPRARPGLGPRQLLTGPRDGAAGQGPGRGLTARLGREREIDCGPRQAGHGGTATDTGRAGSGARHRPPRDRGTPGLRTH

SEQ ID NO: 10232 - protein, 144 aa, Homo sapiens
MTRMTRPLKSHVQVVPSTLMWQSQARTQPAPLCCKLLTPRWLPLLLPTHPHSHCLAGHLFFPARYSCSSEWKQQLTCHLCVTDSAPPRHTGVVVSEHLRRTEKLFFTILSPNQSKPFKTWKMLKATIPIFVCFLLNLAQNPRPL

SEQ ID NO: 10233 - protein, 340 aa, Homo sapiens
MKYGNPNYGGMKGILSNSWKRRYHSRRIQRDVIKKRALIGDDVGLTSYKHRHSGLVNVPEEPIEEEEEEEEEEEEEEEEDQDMDADDRVVVEYHEELPALKQPRERSASRRSSASSSDSDEMDYDLELKMISTPSPKKSMKMTMYADEVESQLKNIRNSMRADSVSSSNIKNRIGNKLPPEKFADVRHLLDEKRQHSRPRPPVSSTKSDIRQRLGKRPHSPEKAFSSNPVVRREPSSDVHSRLGVPRQDSKGLYADTREKKSGNLWTRLGSAPKTKEKNTKKVDHRAPGAEEDDSELQRAWGALIKEKEQSRQKKSRLDNLPSLQIEVSRESSSGSEAES

SEQ ID NO: 10234 - protein, 620 aa, Homo sapiens
MAAVRGLRVSVKAEAPAGPALGLPSPEAESGVDRGEPEPMEVEEGELEIVPVRRSLKELIPDTSRRYENKAGSFITGIDVTSKEAIEKKEQRAKRFHFRSEVNLAQRNVALDRDMMKKAIPKVRLETIYICGVDEMSTQDVFSYFKEYPPAHIEWLDDTSCNVVWLDEMTATRALINMSSLPAQDKIRSRDASEDKSAEKRKKDKQEDSSDDDEAEEGEVEDENSSDVELDTLSQVEEESLLRNDLRPANKLAKGNRLFMRFATKDDKKELGAARRSQYYMKYGNPNYGGMKGILSNSWKRRYHSRRIQRDVIKKRALIGDDVGLTSYKHRHSGLVNVPEEPIEEEEEEEEEEEEEEEEDQDMDADDRVVVEYHEELPALKQPRERSASRRSSASSSDSDEMDYDLELKMISTPSPKKSMKMTMYADEVESQLKNIRNSMRADSVSSSNIKNRIGNKLPPEKFADVRHLLDEKRQHSRPRPPVSSTKSDIRQRLGKRPHSPEKAFSSNPVVRREPSSDVHSRLGVPRQDSKGLYADTREKKSGNLWTRLGSAPKTKEKNTKKVDHRAPGAEEDDSELQRAWGALIKEKEQSRQKKSRLDNLPSLQIEVSRESSSGSEAES

SEQ ID NO: 10235 - protein, 379 aa, Homo sapiens
METLCPAPRLAVPASPRGSPCSPTPRKPCRGTQEFSPLCLRALAFCALAKPRASSLGPGPGELAARSPVLRGPQAPLRPGGWAPDGLKHLWAPTGRPGVPNTAAGEDADVAACPRRGEEEEGGGGFPHFGVRSCAPPGRCPAPPHPRESTTSFASAPPRPAPGLEPQRGPAASPPQEPSSRPPSPPAGLSTEPAGPGTAPRPFLPGQPAEVDGNPPPAAPEAPAASPSTASPAPAAPGDLRQEHFDRLIRRSKLWCYAKGFALDTPSLRRGPERPPAKGPARGAAKKRRLPAPPPRTAQPRRPAPTLPTTSTFSLLNCFPCPPALVVGEDGDLKPASSLRLQGDSKPPPAHPLWRWQMGGPAVPEPPGLKFWGINMDES

SEQ ID NO: 10236 - protein, 423 aa, Homo sapiens
METRGPGLAVRAESRRLVGIGPRAPPGRVGLQPSGRLDRRGGAGTMGYKDNDGEEEEREGGAAGPRGSRLPPITGGASELAKRKVKKKKRKKKTKGSGKGDDKHQSQSLKSQPLSSSFHDILSPCKERGPKPEHRQSKVEKKHLPSDSSTVSLPDFAEIENLANRINESLRWDGILADPEAEKERIRIYKLNRRKRYRCLALKGFHPDPEALKGFHPDPDALKGFHPDPEALKGFHPDPEALKGIHPDPEALKGFHPDPEALKGFHPDPEALKGFHTDPEALKGFHIDPEALKGFHPDPKALKGFHPDPKALKGFHTDPEALKGFHPDPKALKGFHPDPEALKGFHPDPEALKGFHPDPEALKGFHTDPNAEEAPENLPYLSDKDGSSSHRQPTSKAECPNLCFEGNLTPKLLHSDLAPTLLE

SEQ ID NO: 10237 - protein, 154 aa, Homo sapiens
MAYLSECRLRLEKGFILDGVAVSTAARAYGRSRPKLWSAIPPYNAQQDYHARSYFQSHVVPPLLRKTDQDHGGTGRDGWIVDYIHIFGQGQRYLNRRNWAGTGHSLQQVTGHDHYNADLKPIDGFNGRFGYRRNTPALRQSTSVFGEVTHFPLF

SEQ ID NO: 10238 - protein, 265 aa, Homo sapiens
MGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWFWCQAANNANVQHSALTVVPPGGDQKMEDWQGPLESPILALPLYRSTRRLSEEEFGGFRIGNGEVRGRKAAAM

SEQ ID NO: 10239 - protein, 300 aa, Homo sapiens
MSRPGIVESYEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWFWCQAANNANVQHSALTVVPPGERALGFPEGQLALLCREGASVQDTGRWEVGQLYPATAESREGTGGNHAHPGPCLKEAQPSCLRPLPGGLPRAPTIVLVGSLASTAAITSRMLGWTTWAR

SEQ ID NO: 10240 - protein, 132 aa, Homo sapiens
MVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNESQKIPKVDFRNFLSSLKGGLLK

SEQ ID NO: 10241 - protein, 220 aa, Homo sapiens
MRQKHYLEAAARGLHDSCPGQARYLLWAYTSSHDDKSTFEETCPYCFQLLVLDNSRVRLKPKARLTPKIQKLLNREARNYTLSFKEAKMVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNESQKIPKVDFRNFLSSLKGGLLK

SEQ ID NO: 10242 - protein, 220 aa, Homo sapiens; identical to SEQ ID NO: 10241

SEQ ID NO: 10243 - protein, 403 aa, Homo sapiens
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPDGPPVVAHYDMSDTNSDPEVVNVDNLLAAAVVQEHSNSVGGQDTGATWRTSGLLEELNAEAGHLDPGFLASDKTSGNAPLNEEINIASSDSEVEIVGVQEHARCVHPRGGVIQSVSSWKHGSGTQYVSTRQTQSWTAVTPQQTWASPAEVVDLTLDEDSRRKYLL

SEQ ID NO: 10244 - protein, 342 aa, Homo sapiens
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPGHLDPGFLASDKTSGNAPLNEEINIASSDSEVEIVGVQEHARCVHPRGGVIQSVSSWKHGSGTQYVSTRQTQSWTAVTPQQTWASPAEVVDLTLDEDSRRKYLL

SEQ ID NO: 10245 - protein, 76 aa, Homo sapiens
MVCIPCIVIPVLLWIYKKFLEPYIYPLVSPFVSRIWPKKAIQESNDTNKGKVNFKGADMNGLPTKGPTEICDKKKD

SEQ ID NO: 10246 - protein, 76 aa, Homo sapiens; identical to SEQ ID NO: 10245

SEQ ID NO: 10247 - protein, 829 aa, Homo sapiens
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVSKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQLCQLQRRMHTLWQEHFKLVVLFSQMRLANFQTDSQESIQKILAVQEESSNLMQHILGFFQTLTDGTCENDG

SEQ ID NO: 10248 - protein, 867 aa, Homo sapiens
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQLCQLQRRMHTLWQEHFKLVVLFSQMRLANFQTDSQESIQKILAVQEESSNLMQHILGFFQTLTDGTCENDG

SEQ ID NO: 10249 - protein, 297 aa, Homo sapiens
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKIKKKKK

SEQ ID NO: 10250 - protein, 817 aa, Homo sapiens
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQLCQLQRRMHTLWQEHFKLVVLFSQMRLANFQTDSQESIQKILAVQEESSNLMQHILGFFQTLTDGTCENDG

SEQ ID NO: 10251 - protein, 867 aa, Homo sapiens; identical to SEQ ID NO: 10248

SEQ ID NO: 10252 - protein, 891 aa, Homo sapiens
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQVAGFLPKKLPNSLPIISDELSNFQLCQLQRRMHTLWQEHFKLVVLFSQMRLANFQTDSQESIQKILAVQEESSNLMQHILGFFQTLTDGTCENDG

SEQ ID NO: 10253 - protein, 69 aa, Homo sapiens
MVFAPGEKPGNEPEEVKLQNASKQIVQNAILQAVQQVSQESQRREERISDNRDHIQLGVGELTKKHEKK

SEQ ID NO: 10254 - protein, 123 aa, Homo sapiens
MTPASGATASLGRLRARPRSRWDAAYLPAVAAVCVARASHVPNGTLRFGVCKARRTMRPLPRRIEVRTKRGPQRPAAPERSPQPRLPPSRHPSRRGPRRHLSGCSAPACRIPTGCRCPCGRPS

SEQ ID NO: 10255 - protein, 685 aa, Homo sapiens
MNDSRQQSLFFITLPDLNKLCAVRIILSNKVADTEIRTIQMKMCRQLLFLHQDILTSPVSGILNQIWVVMAIPFYKARKLNAYVEKYGAKMEAPQRVIPVILQNCLSYSFMARLAPAWNRTGHLLIQGRDFLSQMGKQSAVVLNINVTETQVCLSIEACTIRLPAPELKEFEISQSIIKDFHANKHAVIERHSILSNWCYVLPSMKMGQIINIFHAIPAACPFHSYGDFQRHWDALYGYKLPGDCGKIKIYCNIYFKMLGERTFTYPLSCIRSQPMQFFPRVDSEVVLKSFLSDLKSKLPHICGFPIKMTSKPCYYTQELTKPNIQEHKVKPPNLTTKKMLRASLTQATSRKPACAQSLLPCSVAVDHKVELSVSQPTSGIFSALHLQPESVQGRKKSLSIRAPQVHSEVLMPNRGNTQVQHTNLSSQSNITPKFVPVFKNRLLQMNKNTSVLGSPKRKQHDVTQSKLFSLKTSMIQHDKLNLGPAIKNRYSSNIQMQAANNLNQENSRPLQEKNTESSENMTKFPSSRGKSTVSLNKNKQLSNSAVFVVSNNNLGVVKSAVDFQMKGKENLTGKGITQILGKSHGSLKLKRQPHIFESDGETEDPRLLQQQSENQAKEVGTSDHRLIVSKIAHRSKRKLCPESSKTSKKHHSDTVHYGQSSSSKKQILDSDKSKLKKSLIIHNA

SEQ ID NO: 10256 - protein, 657 aa, Homo sapiens
MGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 10257 - protein, 609 aa, Homo sapiens
MGEEDYYLELCERPVQFEKANPVNCVFFDEANKQVFAVRSGGATGVVVKGPDDRNPISFRMDDKGEVKCIKFSLENKILAVQRTSKTVVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 10258 - protein, 500 aa, Homo sapiens
MYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 10259 - protein, 452 aa, Homo sapiens
MYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKMLQSRLKTTCFSIQYSAFLNSETSVCEGAPISHQGNTVKNMLLFSNRFLETKL

SEQ ID NO: 10260 - protein, 679 aa, Homo sapiens
MDRVTRYPILGIPQAHRGTGLVLDGDTSYTYHLVCMGPEASGWGQDEPQTWPTDHRAQQGVQRQGVSYSVHAYTGQPSPRGLHSENREDEGWQVYRLGARDAHQGRPTWALRPEDGEDKEMKTYRLDAGDADPRRLCDLERERWAVIQGQAVRKSSTVATLQGTPDHGDPRTPGPPRSTPLEENVVDREQIDFLAARQQFLSLEQANKGAPHSSPARGTPAGTTPGASQAPKAFNKPHLANGHVVPIKPQVKGVVREENKVRAVPTWASVQVVDDPGSLASVESPGTPKETPIEREIRLAQEREADLREQRGLRQATDHQELVEIPTRPLLTKLSLITAPRRERGRPSLYVQRDIVQETQREEDHRREGLHVGRASTPDWVSEGPQPGLRRALSSDSILSPAPDARAADPAPEVRKVNRIPPDAYQPYLSPGTPQLEFSAFGAFGKPSSLSTAEAKAATSPKATMSPRHLSESSGKPLSTKQEASKPPRGCPQANRGVVRWEYFRLRPLRFRAPDEPQQAQVPHVWGWEVAGAPALRLQKSQSSDLLERERESVLRREQEVAEERRNALFPEVFSPTPDENSDQNSRSSSQASGITGSYSVSESPFFSPIHLHSNVAWTVEDPVDSAPPGQRKKEQWYAGINPSDGINSEVLEAIRVTRHKNAMAERWESRIYASEEDD

SEQ ID NO: 10261 - protein, 161 aa, Homo sapiens
MGSKAKKRVLLPTRPAPPTVEQILEDVRGAPAEDPVFTILAPEDPPVPFRMMEDAEAPGEQLYQQSRAYVAANQRLQQAGNVPRLPPQADLSGPAGLGSAQGGLHPGFPWGSVGPRLAFTGSQPTWVLTQAPLLMLGLRFIRRLIHAELVGPTQLAPSCVT

SEQ ID NO: 10262 - protein, 158 aa, Homo sapiens
MGSKAKKRVLLPTRPAPPTVEQILEDVRGAPAEDPVFTILAPEGRGSPVPGKSGPETPAARGRERSTPLTPDPTPWEPPQHGHDPPVPFRMMEDAEAPGEQLYQQSRAYVAANQRLQQAGNVLRQRCELLQRAGEDLEREVAQMKQAALPAAEAASSG

SEQ ID NO: 10263 - protein, 118 aa, Homo sapiens
MGSKAKKRVLLPTRPAPPTVEQILEDVRGAPAEDPVFTILAPEDPPVPFRMMEDAEAPGEQLYQQSRAYVAANQRLQQAGNVLRQRCELLQRAGEDLEREVAQMKQAALPAAEAASSG

SEQ ID NO: 10264 - protein, 447 aa, Homo sapiens [sequence omitted]

SEQ ID NO: 10265 - protein, 473 aa, Homo sapiens
MSSPEPPTEPPEPDNPTWSTQPTYSNLGQIRAHLLPSKACRLRTPGSLSTNPEPLPPPLPKKILTRTQSLPTRRTLHPSSIQVQPPRRPFLGSHSVDKSQAAVGPACLPAELTFGPADAPLGLSLRDLHSPEAVHTALAARQLQGLRTIYARLRARLMGGHPGPCHPGHSFRLLDSSPCAESGDALYYRVVRAHEDAWHILVAKVPKPGADVPHPWGLELQASLSPHFNLQGLCGLVPEGTLPGAPWRGAVALAAEVPERTVAQWLAEACTQPPEEFVWAVALLLLQLSAALKFLEAWGAALVELRPENLLLVAPRGCATTGPPRLLLTDFGRVCLQPPGPPGSPGPHAPQLGSLLRALLSLAAPSTTPLAAGLELLAAQLTRLRPSASRTRGALQALLWGPGPELRGRGAPLGPWLRALGPWLRVRRGLLVLRLAERAAGGEAPSLEDWLCCEYLAEATESSMGQALALLWD

SEQ ID NO: 10266 - protein, 75 aa, Homo sapiens
MIGDILLFGTLLMNAGAVLNFKLKKKDTQGFGEESREPSTGDNIREFLLSLRYFRIFIALWNIFMMFCMIVLFGS

SEQ ID NO: 10267 - protein, 176 aa, Homo sapiens
MAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGPGSTLSFVGKRRGGNKLALKTGIVAKKQKTEDEVLTSKGDAWAKYMAEVKKYKAHQCGDDDKTRPLVK

SEQ ID NO: 10268 - protein, 505 aa, Homo sapiens
MATGALLPCSRPCPMSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHDARPQPRAPSCHLGGPNTLKWDYTRQDGTSYQRQFQALPGPPALRCKRASSGVELGDCKISYGSTCSEQKQAYRPQDLPEDRYDKAQATAHIHCVNIRPGDGLFRDRTTKAEHFYAREPEPFVLHHDQTPESHILKGNWCPGPGSLDTFMQYFYGQPPPPTQPPSRHVPHEKLQSHVTLGEPKLLKRFFKTTMGSDYCPSEWRQVQKAPNLHLQQSYLPRGTGEFDFLTMNQKMLKPHRTPPAPVTEEMLQRCKYSHMEPPLGGLRFFSTQYKDEFPFKYQGPAALRLKNPQEGFVPLGTPHQRGCREKIDPLVPQPPMYLCPSQQ

SEQ ID NO: 10269 - protein, 223 aa, Homo sapiens
MATGALLPCSRPCPMSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHDARPQPRAPSCHLGGPNTLKWDYTRQDGTSYQRQFQALPGPPAL

SEQ ID NO: 10270 - protein, 192 aa, Homo sapiens
MATGALLPCSRPCPMSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHDARPQPRAPSCHL

SEQ ID NO: 10271 - protein, 422 aa, Homo sapiens
MVMAALSLVAACWGRAAADESVQLPAAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 10272 - protein, 355 aa, Homo sapiens
MFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 10273 - protein, 422 aa, Homo sapiens; identical to SEQ ID NO: 10271

SEQ ID NO: 10274 - protein, 117 aa, Homo sapiens
MTVLEAVLEIQAITGSRLLSMVPGPARPPGSCWDPTQCTRTWLLSHTPRRRWISGLPRASCRLGEEPPPLPYCDQAYGEELSIRHRETWAWLSRTDTAWPGAPGVKQARILGELLLV

SEQ ID NO: 10275 - protein, 117 aa, Homo sapiens; identical to SEQ ID NO: 10274

SEQ ID NO: 10276 - protein, 608 aa, Homo sapiens [sequence omitted]

SEQ ID NO: 10277 - protein, 588 aa, Homo sapiens
MLPLLDSSKRAGTLGSGCGVPRVHSAALSREEGASRDIWRIKVWARVMTTPAGSGSGFGSVSWWGLSPALDLQAESPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLDSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 10278 - protein, 487 aa, Homo sapiens
MKMRAQIPESLREEGIEILKPQFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLDSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 10279 - protein, 260 aa, Homo sapiens
MAAAALRRFWSRRRAEAGDAVVAKPGVWARLGSWARALLRDYAEACRDASAEARARPGRAAVYVGLLGGAAACFTLAPSEGAFEEALLEASGTLLLLAPATRNRESEAFVQRLLWLRGRGRLRYVNLGLCSLVYEAPFDAQASLYQARCRYLQPRWTDFPGRVLDVGFVGRWWVLGAWMRDCDINDDEFLHLPAHLRVVGPQQLHSETNERLFDEKYKPVVLTDDQVDQALWEEQVLQKEKKDRLALSQAHSLVQAEAPR

SEQ ID NO: 10280 - protein, 99 aa, Homo sapiens
MAQGQRKFQAHKPAKSKTAAAASEKNRGPRKGGRVIAPKKARVVQQQKLKKNLEVGIRKKIEHDVVMKASSSLPKKLALLKAPAKKKGAAAATSSKTPS

SEQ ID NO: 10281 - protein, 99 aa, Homo sapiens; identical to SEQ ID NO: 10280

SEQ ID NO: 10282 - protein, 139 aa, Homo sapiens
MRAGGLVDGRYSPVAPQWRPPGETHTGGHGKRLHGPGRDVLSTSYDEDFNHEPCQRKGHKAHWAVSAGVLLGVRAVPSLGYTEDPELPGLFHPVLGTPCQPPSLPEEGSPGAVYLLSKQGKSWHYQLWDYDQGPPLSSH

SEQ ID NO: 10283 - protein, 351 aa, Homo sapiens
MTSPCSPPLKPPISPPKTPVPQASSIPSPPLPPSPLDFSALPSPPWSQQTPVPPPLPLPPPPAATGPAPRHVFGLEKSQLLKEAFDKAGPVPKGREDVKRLLKLHKDRFRGDLRWILFCADLPSLIQEGPQCGLVALWMAGTLLSPPSGVPLERLIRVATERGYTAQGEMFSVADMGRLAQEVLGCQAKLLSGGLGGPNRDLVLQHLVTGHPLLIPYDEDFNHEPCQRKGHKAHWAVSAGVLLGVRAVPSLGYTEDPELPGLFHPVLGTPCQPPSLPEEGSPGAVYLLSKQGKSWHYQLWDYDQVRESNLQLTDFSPSRATDGRVYVVPVGGVRAGLCGQALLLTPQDCSH

SEQ ID NO: 10284 - protein, 479 aa, Homo sapiens
MDRSLPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAAGANKPEGRPHTAVPTAVNVTSASHAVAPLQEIKQNLHTWNSSLLDLETLSLQSRAARLLKRSKASISSSSSLSPSDASTSSFPTSSDGLSPFSETFIPDSSKGLGPRAPASPAPAQAQTPTPAPAPASSQAPLRPEDDILYQWRQRRKLEQAQGSKGDRAWVPPLTPALRTLAESLKAKALPPAAGSVIRKSEATPSPGACLQPEVPLSPAEQATTVKASPPAFQVGSPEALAPPPPAADHAPSEALLAQALLLQAAEDSDGSEFQDDPVLQVLRAHRAELSRQKREADARLSFLLDQAEDLGSWSPPAGSPPRSPRRLLRREGDSLEARRL

SEQ ID NO: 10285 - protein, 109 aa, Homo sapiens [sequence omitted]

SEQ ID NO: 10286 - protein, 637 aa, Homo sapiens
MTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPSRLIMGTHRDLEAFKRLNYRKTKLGGKAPLPYPSKGPGNIPRGDPPWREL

SEQ ID NO: 10287 - protein, 668 aa, Homo sapiens
MTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

SEQ ID NO: 10288 - protein, 201 aa, Homo sapiens
MITETAAEPTVPAVPAAEEATEARGREEPAWPWKDAPIRTLVQRIHQLQAERAQGFRRLEEWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 10289 - protein, 179 aa, Homo sapiens
MITETAAEPTVPAVPAAEEATEARGREEPAWPWKDAPIRTLVQRIHQLQAERAQGFRRLEEGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 10290 - protein, 291 aa, Homo sapiens
MSQEGVELEKSVRRLREKFHGKVSSKKAGALMRKFGSDHTGVGRSIVYGVKQKDGQELSNDLDAQDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRGWAQMGSPSPCYGCGFPVYPTRILPPRWDRDPDRRSTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 10291 - protein, 240 aa, Homo sapiens
MSQHQQACGICRQEDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRGWAQMGSPSPCYGCGFPVYPTRILPPRWDRDPDRRSTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 10292 - protein, 627 aa, Homo sapiens
MERPEPPPGTAAGQEEQELRERAFFSWAEFSRFFDAWCQQRLALFFVKSSMHLARCRWASAPPLYTLIDVLKYSYVRLVCKDVRAPSRPAVGPPQPGCPAFIIVKLSPLRDRLVVTECQLTHSHPACPLEFAYYFRPGHLLANACLPVRTTNKISKQFVAPADVRRLLSYCKGRDHGVLDALHVLEGLFRTDPEAKVKLVFVEDQAVVETVFFLTSRTRALLRRFPRMLLVDRLPGLQGALDLLAVLCVDGSGRARQAACCVARPGTPSLLRFALASLLQSAPDVKGRVRCLTAGPEVAAQLPAVRQLLPCARVQICRAQGLETLFSKAQELGGAGREDPGLWSRLCRLAGASSPAAYDEALAELHAHGPAAFVDYFERNWEPRRDMWVRFRAFEAARDLDACALVRGHRRRLLRRLSPSRGVAQCLRDLVAMQWADAAGEAVPEGPDGGGPWLEDEPGRGAQGENERVRGLETGDWGGAPKEGSIWRGAQMEKEWARALETRDWGGAQFEGEKGRALQIRDWRGGRLENQKPRGLEGGVLRGSKLEKGHLRGPEIRDWRGPQLEGEKDWGLEGYVWRGSQLEDQALRGLEGYTWRVAQLEDRRSTTDLRGTQFDYERGKGESTEDR

SEQ ID NO: 10293 - protein, 130 aa, Homo sapiens
MELWRQLNQAGLVPPGLGPPPQALREVSPVEIPGQTLRTAGADTGGACDSLLWIREELGNLRRVDVQLLGQLCSLGLEMGALREELVTILEEEEESSKEEEEDQEPQRKQEEEHLEACPAPHPPDFEMMI

SEQ ID NO: 10294 - protein, 209 aa, Homo sapiens
MQTLRQEAARPCIPSGTLEASFPAPLYSDDYLSLEGSRWPPAIRQATRWKYTPMGRDAAGQLWYTGLTNSDAWEAWYNLPRAPASPFREAYNRWHSCYQHRECSMPSAYTQHLRETAWHDPIVPAQYQAPSTRWGSALWKDRPIRGKEYVLNRNRYGVEPLWRASDYVPSLSAPQRPPGTTQNYREWVLEPYCPSTCQRSPPSLTPTPR

SEQ ID NO: 10295 - protein, 129 aa, Homo sapiens
MRLKVGFQGGGCFRKDALCLEGGVSARWARAPHSAPLRPPRELHAAPPPATPTQTVVRPAGFPRRTRLMVRSAPPTQRPPTGSGCVSGLWRKGLGLRPQTLLRVGSVVLSSAPALRPRLGPCLRPPPSD

SEQ ID NO: 10296 - protein, 73 aa, Homo sapiens
MGVKLEIFRMIIYLTFPVAMFWVSNQAEWFEDDVIQRKRELWPPEKLQEIEEFKERLRKRREEKLLRDAQQNS

SEQ ID NO: 10297 - protein, 1984 aa, Homo sapiens
MELTPGAQQQGINYQELTSGWQDVKSMMLVPEPTRKFPSGPLLTSVRFSNLSPESQQQDVKSLEFTVEPKLQSVKHVKLSSVSLQQTIKSVELAPGSLPQRVKYGEQTPRTNYQIMESSELIPRPGHQFAKYAEMIPQPKYQIPKSANLISIPIYHATESSEMAQGLAYKGIDTVEKSVGLTPKLTGRAKESLGMLLQPDLQVPKFVDLTPMVRDQGSKFLGLTPEKSYQILETMELLSQSRPRVKDVGELYMKPLQQTVEYEGITPELKHYFTEAMGLTAEARIQANEFFGMTPKPTSQATGFAERSPRLCPQNLECVEVISEKRLQGEESVVLIPKSLHHVPDSASGMTPGLGHRVPESVELTSKSGVQVEKTLQLTPKPQHHVGSPGIISGLGHQVPESVNLTCKQWLQMEESLEVPLKQTSQVIGHEESVELTSEARQHREVSMGLTKSKNQSMKSPGTTPGPLGRIVEFMRISPEPLDQVTESARTQLQVAQSEEVILIDVPKVVQSVKVTPGPPFQIVKSVTIPRPTPQMVEYIELTPKLQYVRPSEHHTGPCLQDVKSTKLITKPKHQILETVELTGFQIVKTMLIPGPSLQIVKSEELAPGPIPQVVEPIGVALESGIEAINCVDLLPRPHLQELIVPAELTPSPCTQVKSAELTSPQTSPFEEHTILTHKQGLQAVKSTVIKTEPPKVMETEDLNLGHVCQNRDCQKLTSEELQVGTDFSRFLQSSSTTLISSSVRTASELGGLWDSGIQEVSRALDIKNPGTDILQPEETYIDPTMIQSLTFPLALHNQSSDKTANIVENPCPEILGVDVISKETTKRKQMEELENSLQRHLPQSWRSRSRTFQAESGVQKGLIKSFPGRQHNVWESHAWRQRLPRKYLSTMLMLGNILGTTMERKLCSQTSLAERATADTCQSIQNLFGIPAELMEPSQSLPEKGPVTISQPSVVKNYIQRHTFYHGHKKRMALRIWTRGSTSSIIQQYSGTRVRIKKTNSTFNGISQEVIQHMPVSCAGGQLPVLVKSESSLSIFYDREDLVPMEESEDSQSDSQTRISESQHSLKPNYLSQAKTDFSEQFQLLEDLQLKIAAKLLRSQIPPDVPPPLASGLVLKYPICLQCGRCSGLNCHHKLQTTSGPYLLIYPQLHLVRTPEGHGEVRLHLGFRLRIGKRSQISKYRERDRPVIRRSPISPSQRKAKIYTQASKSPTSTIDLQSGPSQSPAPVQVYIRRGQRSRPDLVEKTKTRAPGHYEFTQVHNLPESDSESTQNEKRAKVRTKKTSDSKYPMKRITKRLRKHRKFYTNSRTTIESPSRELAAHLRRKRIGATQTSTASLKRQPKKPSQPKFMQLLFQSLKRAFQTAHRVIASVGRKPVDGTRPDNLWASKNYYPKQNARDYCLPSSIKRDKRSADKLTPAGSTIKQEDILWGGTVQCRSAQQPRRAYSFQPRPLRLPKPTDSQSGIAFQTASVGQPLRTVQKDSSSRSKKNFYRNETSSQESKNLSTPGTRVQARGRILPGSPVKRTWHRHLKDKLTHKEHNHPSFYRERTPRGPSERTRHNPSWRNHRSPSERSQRSSLERRHHSPSQRSHCSPSRKNHSSPSERSWRSPSQRNHCSPPERSCHSLSERGLHSPSQRSHRGPSQRRHHSPSERSHRSPSERSHRSSSERRHRSPSQRSHRGPSERSHCSPSERRHRSPSQRSHRGPSERRHHSPSKRSHRSPARRSHRSPSERSHHSPSERSHHSPSERRHHSPSERSHCSPSERSHCSPSERRHRSPSERRHHSPSEKSHHSPSERSHHSPSERRRHSPLERSRHSLLERSHRSPSERRSHRSFERSHRRISERSHSPSEKSHLSPLERSRCSPSERRGHSSSGKTCHSPSERSHRSPSGMRQGRTSERSHRSSCERTRHSPSEMRPGRPSGRNHCSPSERSRRSPLKEGLKYSFPGERPSHSLSRDFKNQTTLLGTTHKNPKAGQVWRPEATR

SEQ ID NO: 10298 - protein, 203 aa, Homo sapiens
MTVKWKQLSAPASGAEIQRFPVPAVEPVPAPGADSPPGTALELEEAPEPSCRCPGTAQDQPSEELPDFMAPPVEPPASALELKVWLELEVAERGGQHSSSQQLPHCSQSWAQWKLWRQRPGFAIWAPLPHWRGTSLIQQSSSPAAEGPAATAAGAVCLPAGGAGEQEKEPVSRGSSRSSCSQRRPPPPGMEVCPQLGIWAICP

SEQ ID NO: 10299 - protein, 209 aa, Homo sapiens
MFVRPESGEQGPETLAPASGAEIQRFPVPAVEPVPAPGADSPPGTALELEEAPEPSCRCPGTAQDQPSEELPDFMAPPVEPPASALELKVWLELEVAERGGQHSSSQQLPHCSQSWAQWKLWRQRPGFAIWAPLPHWRGTSLIQQSSSPAAEGPAATAAGAVCLPAGGAGEQEKEPVSRGSSRSSCSQRRPPPPGMEVCPQLGIWAICP

SEQ ID NO: 10300 - protein, 574 aa, Homo sapiens
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAMQASPETKQTIWQLATEPTGPLVQRITKNILVVKCKASQKHSLGYLHTSFVQKVSGKSLPERRFFCSCQTLKSHKSNASKDETAQRCIHFFACICAFASDETLAQEFSDFLNFDSSGLKEIIVPQLGCHSESTVSACESTASKSKKRRKDEVSGAQMNSSLLPQDAVSSNLRKSGLKKPVVASSLKRQACGQLLDEAQVTLSFQDWLASVTERIHQTMHYQFDGKPEPLVFHIPQSFFDALQQRISIGSAKKRLPNSTTAFVRKDALPLGTFSKYTWHITNILQVKQILDTPEMPLEITRSFIQNRDGTYELFKCPKVEVESIAETYGRIEKQPVLRPLELKTFLKVGNTSPDQKEPTPFIIEWIPDILPQSKIGELRIKFEYGHHRNGHVAEYQDQRPPLDQPLELAPLTTITFP

SEQ ID NO: 10301 - protein, 22 aa, Homo sapiens
MEPNSLRTKVPAFLSDLGKATL

SEQ ID NO: 10302 - protein, 159 aa, Homo sapiens
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAM

SEQ ID NO: 10303 - protein, 128 aa, Homo sapiens
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGV

SEQ ID NO: 10304 - protein, 574 aa, Homo sapiens; identical to SEQ ID NO: 10300

SEQ ID NO: 10305 - protein, 59 aa, Homo sapiens
MEPNSLRTKVPAFLSDLGKATLRGIRKCPRCGTYNGTRGLSCKNKTCGTIFRYGARKQP

SEQ ID NO: 10306 - protein, 60 aa, Homo sapiens
MEPNSLRTKVPAFLSDLGKATLRGIRKCPRCGTYNGTRGLSCKNKTCGTIFRYGARKQPS

SEQ ID NO: 10307 - protein, 31 aa, Homo sapiens
MEPNSLRTKVPAFLSDLGKATLRGIRKCPRC

SEQ ID NO: 10308 - protein, 168 aa, Homo sapiens
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAMQASPETKQT

SEQ ID NO: 10309 - protein, 112 aa, Homo sapiens
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSS

SEQ ID NO: 10310 - protein, 325 aa, Homo sapiens
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 10311 - protein, 277 aa, Homo sapiens
MDSELKEEIPVHEEFILCGGAETQVLKCGPWTDLFHDQSVKRPKLLIFIIPDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 10312 - protein, 166 aa, Homo sapiens
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPLMLPTLGAKK

SEQ ID NO: 10313 - protein, 195 aa, Homo sapiens
MKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 10314 - protein, 721 aa, Homo sapiens
MELGKGKLLRTGLNALHQAVHPIHGLAWTDGNQVVLTDLRLHSGEVKFGDSKVIGQFECVCGLSWAPPVADDTPVLLAVQHEKHVTVWQLCPSPMESSKWLTSQTCEIRGSLPILPQGCVWHPKCAILTVLTAQDVSIFPNVHSDDSQVKADINTQGRIHCACWTQDGLRLVVAVGSSLHSYIWDSAQKTLHRCSSCLVFDVDSHVCSITATVDSQVAIATELPLDKICGLNASETFNIPPNSKDMTPYALPVIGEVRSMDKEATDSETNSEVSVSSSYLEPLDLTHIHFNQHKSEGNSLICLRKKDYLTGTGQDSSHLVLVTFKKAVTMTRKVTIPGILVPDLIAFNLKAHVVAVASNTCNIILIYSVIPSSVPNIQQIRLENTERPKGICFLTDQLLLILVGKQKLTDTTFLPSSKSDQYAISLIVREIMLEEEPSITSGESQTTYSTFSAPLNKANRKKLIESLSPDFCHQNKGLLLTVNTSSQNGRPGRTLIKEIQSPLSSICDGSIALDAEPVTQPASLPRHSSTPDHTSTLEPPRLPQRKNLQSEKETYQLSKEVEILSRNLVEMQRCLSELTNRLHNGKKSSSVYPLSQDLPYVHIIYQKPYYLGPVVEKRAVLLCDGKLRLSTVQQTFGLSLIEMLHDSHWILLSADSEGFIPLTFTATQEIIIRDGSLSRSDVFRDSFSHSPGAVSSLKVFTGLAAPSLDTTGCCNHVDGMA

SEQ ID NO: 10315 - protein, 174 aa, Homo sapiens
MELGKGKLLRTGLNALHQAVHPIHGLAWTDGNQVVLTDLRLHSGEVKFGDSKVIGQFECVCGLSWAPPVADDTPVLLAVQHEKHVTVWQLCPSPMESSKWLTSQTCEIRGSLPILPQGCVWHPKCAILTVLTAQDVSIFPNVHSDDSQVKADINTQGRIHCACWTQDGLRLVVA

SEQ ID NO: 10316 - protein, 622 aa, Homo sapiens
MELGKGKLLRTGLNALHQAVHPIHGLAWTDGNQVVLTDLRLHSGEVKFGDSKVIGQFECVCGLSWAPPVADDTPVLLAVQHEKHVTVWQLCPSPMESSKWLTSQTCEIRGSLPILPQGCVWHPKCAILTVLTAQDVSIFPNVHSDDSQVKADINTQGRIHCACWTQDGLRLVVAVGSSLHSYIWDSAQKTLHRCSSCLVFDVDSHVCSITATVDSQVAIATELPLDKICGLNASETFNIPPNSKDMTPYALPVIGEVRSMDKEATDSETNSEVSVSSSYLEPLDLTHIHFNQHKSEGNSLICLRKKDYLTGTGQDSSHLVLVTFKKAVTMTRKVTIPGILVPDLIAFNLKAHVVAVASNTCNIILIYSVIPSSVPNIQQIRLENTERPKGICFLTDQLLLILVGKQKLTDTTFLPSSKSDQYAISLIVREIMLEEEPSITSGESQTTYSTFSAPLNKANRKKLIESLSPDFCHQNKGLLLTVNTSSQNGRPGRTLIKEIQSPLSSICDGSIALDAEPVTQPASLPRHSSTPDHTSTLEPPRLPQRKNLQSEKETYQLSKEVEILSRNLVEMQRCLSELTNRLHNGKKSSSVYPLSQDLPYVHIIYQIPTGFFSLLTVRALSR

SEQ ID NO: 10317 - protein, 159 aa, Homo sapiens
MESRPSGRQHASEGDGDQSPTQCAGMRSSGRSDQPYVLKGNPLLLRVRCYSGCASGSGRQLQLSVFQDLNQFSHCRVWRSPALIVKGEPPWCSQQDTQSPFQTGTPLERPCFRMKLSGWELTKNAQRALGSKLQHILSLDSTQACGAGGPTILRPPRAP

SEQ ID NO: 10318 - protein, 232 aa, Homo sapiens
MAGDVGGRSCTDSELLLHPELLSQEFLLLTLEQKNIAVETDVRVNKDSLTDLYVQHAIPLPQRDLPKNRWGKMMEKKREQHEIKNETKRSSTVDGLRKRPLIVFDGSSTSTSIKVKKTENGDNDRLKPPPQASFTSNAFRKLSNSSSSVSPLILSSNLPVNNKTEHNNNDAKQNHDLTHRKSPSGPVKSPPLSPVGTTPVKLKRAAPKEEAEAMNNLKPPQAKRKIQHVTWP

SEQ ID NO: 10319 - protein, 228 aa, Homo sapiens
MRRLRVTTHASLRPSTSLPQRFLRGALWVADWGLLATTMAGDVGGRSCTDSELLLHPELLSQEFLLLTLEQKNIAVETDVRVNKDSLTDLYVQHAIPLPQRDLPKNRWGKMMEKKREQHEIKNETKRSSTVDGLRKRPLIVFDGSSTSTSIKVKKTENGDNDRLKPPPQNHDLTHRKSPSGPVKSPPLSPVGTTPVKLKRAAPKEEAEAMNNLKPPQAKRKIQHVTWP

SEQ ID NO: 10320 - protein, 162 aa, Homo sapiens
MGSHPTPGLQRTTSAGYRLPPTRPPASVSPAARGGPMASRGLAGGCQAPQALKAQRVAQGAACDGVQQDQLWRELLEAERRGQQRWIQNWSFLKDYDPMGNKKEPEKLPDHVPLFSDTVPSSTNQVVGSRLDTPLGQTLIRMDFFFTEGARKKKLEDQMQPI

SEQ ID NO: 10321 - protein, 162 aa, Homo sapiens; identical to SEQ ID NO: 10320

SEQ ID NO: 10322 - protein, 412 aa, Homo sapiens
MLPQNKDQVLPQTSVLPGRPTWGFSQLVDSSPHNLQPLSPHQGLPPSQPPFSSTQSRRPSSPPPASPSPGFQFGSCDSNSDFAPHPYSPSLPSSPTFFHQNYLSLPRPRASSPSNHWLYPSPPLTPSFSPSQPQNSSLPHSPCQSPSHPEELHSSTLTSPGPSPPSHRLHSNRQTWRWHQYRDTGSGSPGVVERCVPSEKDPAQFRDPGALAQALVVQLGHRRIAHDLRLLLLQHLWLGRTGQAPVVEYPICLVCLRPRSPSCPLPRYRTGPRLLAFPQLLPCVQGQESGPLRIGIGFGLRLPQGQARALHLLPEKRPKEAGPQGKATQACGHQLPASQPPAAQARADPVPGTPSQTRSFRSAGLQSPNSPRCFSGPPPRAPKQVTTSLKPRPCPGPKRPVSLELILQKSSV

SEQ ID NO: 10323 - protein, 298 aa, Homo sapiens
MDTGVWGWGAAACRWGPAERAAGSLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFLAPEDWAELQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 10324 - protein, 447 aa, Homo sapiens
MPAPALPTSAMAVQVPLWHHYLQAIRSREAPRAQDFQRAENVLLTVLERVHALDPRFIVDYSRGLEAFQFALRSSEDPMDMEVPLWVDAEALLIEEPEATQPEDGLELCHLGVPREGAGLERWTTEDTFTASSEGDAKCRGHIVPSKVLCVLKDLLVAAIVHCKHHSLIAPGSLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFLAPEDWAELQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 10325 - protein, 279 aa, Homo sapiens
MDTGSLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFLAPEDWAELQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 10326 - protein, 133 aa, Homo sapiens
MPAPALPTSAMAVQVPLWHHYLQAIRSREAPRAQDFQRAENVLLTVLERVHALDPRFIVDYSRGLEAFQFALRSSEDPMDMEVPLWVDAEALLIEEPEATQPEDGLELCHLGVPREGAGLERWTTEDTFTASS

SEQ ID NO: 10327 - protein, 962 aa, Homo sapiens
MISTRVMDIKLREAAEGLGEDSTGKKKSKFKTFKKFFGKKKRKESPSSTGSSTWKQSQTRNEVIAIESGPVGYDSEDELEESRGTLGSRALSHDSIFIPESGQDATRPVRVFSQENVCDRIKALQLKIQCNVKMGPPPPPGGLPAKRGEDAGMSSEDDGLPRSPPEMSLLHDVGPGTTIKVSVVSPDHVSDSTVSARISDNSLAPVADFSYPAESSSCLDNSAAKHKLQVKPRNQRSSKMRRLSSRAQSESLSDLTCTPEEEENEEKPLLEVSPEERPSSGQQDVAPDRGPEPGPPAPLPPPGGARARRARLQHSSALTASVEEGGVPGEDPSSRPATPELAEPESAPTLRVEPPSPPEGPPNPGPDGGKQDGEAPPAGPCAPATDKAEEVVCAPEDVASPFPTAIPEGDTTPPETDPAATSEAPSARDGPERSVPKEAEPTPPVLPDEEKGPPGPAPEPEREAETEPERGAGTEPERIGTEPSTAPAPSPPAPKSCLKHRPAAASEGPAASPPLAAAESPPVEPGPGSLDAEAAAPERPKAERAEAPPAGAERAAPERKAERGGAELRGAKKFSVSSCRARPRPGVSRPLERASGRLPLARSGPVWRSEAALDDLQGLPEPQHAKPGPRKLAERGPQDSGDRAASPAGPRKSPQEAAAAPGTREPCPAAQEPAPSEDRNPFPVKLRSTSLSLKYRDGASQEVKGVKRYSAEVRLERSLTVLPKEEKCPLGTAPALRGTRAPSDQGKGKARPPEPLSSKPPLPRKPLLQSFTLPHQPAPPDAGPGEREPRKEPRTAEKRPLRRGAEKSLPPAATGPGADGQPAPPWITVTRQKRRGTLDQPPNQEDKPGARTLKSEPGKQAKVPERGQEPVKQADFVRSKSFLITPVKPAVDRKQGAKLNFKEGLQRGISLSHQNLAQSAVMMEKELHQLKRASYASTDQPSWMELARKKSQAWSDMPQIIK

SEQ ID NO: 10328 - protein, 395 aa, Homo sapiens
MALPGYPLGNVDDSRSKDSPAGEPQGQVPLTADVLAVSSSVASTDWQDIDQASFKTATPRAISTSGDKDKSAVVPEHGQKTPRKITPLLPSQNPSPLQVSMSLQNPAWDRQVQDARTSQSLVVFPSHLLGKDKMSQMASVPEREPESAPSAPSAELQSTQHMEAQPVESDADHVTAGANGQHGPQAASTTKSAEEKAEHPKAPHPEAEALPSDESPVAMGANVVDSLGDLQTWFFPPPPAGSVSPSPGPHEVALGRRPLDSSLYTASEENSYMRSMTSLLDRGEGSISSLADILVWSETTMGMAIATGFLDSGHSTVADLLHSSGPSLRSVPSLVGSVSSAFSSGLVSGTSSALRTITRVLETVEQRTVEGIRSAMRYLTSHLTPRQAQADPNYD

SEQ ID NO: 10329 - protein, 177 aa, Homo sapiens
MDQPAVATASTSIREDLVGGESFITASKPAQKTSSFEREGWWRIALTDTPIPGTYHLKTFIEESLLNPVIATYNFKNEGRKKPPLVQRNNPVLNDLPQYMPPDFLDLLKKQVATYSFKDKPRPSPSTLVDKDQSLQLSPGQYNVLPAPVPKYASRSCVFRSTVQRFPTTYFIPVSIM

SEQ ID NO: 10330 - protein, 248 aa, Homo sapiens
MDQPAVATASTSIREDLVGGESFITASKPAQKTSSFEREGWWRIALTDTPIPGTYHLKTFIEESLLNPVIATYNFKNEGRKKPPLVQRNNPVLNDLPQYMPPDFLDLLKKQVATYSFKDKPRPSPSTLVDKDQSLQLSPGQYNVLPAPVPKYASRSCVFRSTVQRFPTTYFIPHEGPGPGHYNVKMPPTSSVTSCFQSRVPRFLPSCSKTPGPGAYTTLRQFPKQSPTIAKMGQEHSLFFNNNNWLLK

SEQ ID NO: 10331 - protein, 387 aa, Homo sapiens
MSSKVYSTGSRAKDHQPSGPECLPLPEANAEAIDFLSSLHKEELQMLFFSETLAMVSDTGEPQGELTIEVQRGKYQEKLGMLTYCLFVHASSRGFLDKMLCGNSLLGYLSEKLELMEQHSQDFIKFLILPMERKMSLLKQDDQLAVTRSIKEGEEVKTGVTSFPWSSIKGFISEAANLVLLRVMAWRRMVPSNARFLTLDTEGKLCYLTYQNLGFQTIQVDHQQAEVFIVEQTVHAEEGIPMSCQYYLLSDGHLAKRIQVGSPGCCIITKMPILREEDEIEPRPVFEKKPLVWEEDMELYSKFLDRKEELRLGHASYLRQHPEAHALISDFLLFLLLRQPEDVVTFAAEFFGPFDPWRPSSPALGSSHRPNPFRSLEPEGDARSGAA

SEQ ID NO: 10332 - protein, 586 aa, Homo sapiens
MSVHQIRKHAVLPPIICRSDKEFLESVQRYIITETERLGCSEEGPADEYYIIYRNVFDKVIEHITAYKSILTSIKKEYDAFIETIKKDRRTTFCLHGKLKGLAAEPTALVYYRKRTIQLEAKMRIIESNSSKIQSQIDHIKQCRAEYDTKEVKYCTFSKDPSKPIPGMTLQESMNLDALTKYMKHLEDKYAEIKQAMLIKYVPAQRKADLDEEMIVLLKRRDVAENLNKKLQFCHQRLQIISQALSSWVKSDMSSPFQDFVEQIQKTKYLQGDQGIVEELMEDDPRRAKEAEIMLHYIERFNELISLGEYEKAACYAANSPRRILRNIGTMNTFKAVGKIRGKPLPLLLFFEALFITSHAFPCPVDAALTLEGIKCGLSEKRLDLVTNWVTQERLTFSEEAGDVICDYGEQDTYNKAKCLALAQIVYSECGLHKKAILCLCKQGQTHRVMEYIQQLKDFTTDDLLQLLMSCPQVELIQCLTKELNEKQPSLSFGLAILHLFSADMKKVGIKLLQEINKGGIDAVESLMINDSFCSIEKWQEVANICSQNGFDKLSNDITSILRSQAAVTEISEEDDAVNLMEHVFW

SEQ ID NO: 10333 - protein, 46 aa, Homo sapiens
MSVHQIRKHAVLPPIICRSDKEFLESVQRYIITETERLGCSEEGPA

SEQ ID NO: 10334 - protein, 137 aa, Homo sapiens
MEYIQQLKDFTTDDLLQLLMSCPQVELIQCLTKELNEKQPSLSFGLAILHLFSADMKKVGIKLLQEINKGGIDAVESLMINDSFCSIEKWQEVANICSQNGFDKLSNDITSILRSQAAVTEISEEDDAVNLMEHVFW

SEQ ID NO: 10335 - protein, 586 aa, Homo sapiens; identical to SEQ ID NO: 10332

SEQ ID NO: 10336 - protein, 17 aa, Homo sapiens
MSVHQIRKHAVLPPIIC

SEQ ID NO: 10337 - protein, 80 aa, Homo sapiens
MSVHQIRKHAVLPPIICRSDKEFLESVQRYIITETERLGCSEEGPADEYYIIYRNVFDKVIEHITAYKSILTSIKKEYDA

SEQ ID NO: 10338 - protein, 166 aa, Homo sapiens
MEAGPHPRPGHCCKPGGRLDMNHGFVHHIRRNQIARDDYDKKVKQAAKEKVRRRHTPAPTRPRKPDLQVYLPRHRDVSAHPRNPDYEESGESSSSGGSELEPSGHQLFCLEYEADSGEVTSVIVYQGDDPGKVSEKVSAHTPLDPPMREALKLRIQEEIAKRQSQH

SEQ ID NO: 10339 - protein, 127 aa, Homo sapiens
MEAGPHPRPGHCCKPGGRLDMNHGFVHHIRRNQIARDDYDKKVKQAAKEKVRRRHTPAPTRPRKPDLQVYLPRHRGEAARPACLQPARSSCNALPFSIGKNHFLLLRFSSSRLFPEPPPQRSQISAE

SEQ ID NO: 10340 - protein, 201 aa, Homo sapiens
MASRSAGTLLTEFNAAYVPPGLMPGYQGHVPTVAFSFGAPYGTTTLKYFQDHRNRAMEKSHTPFSQGGHFPTIFSTNPNLLLMERASTRDRWLHKPSYTRFNLDSHRSTELTNFYQMVQQHRKYYQDKTGTVPRVPYFAMPVREPERYPLPTVLPPLCPKKKWHLLRLAPENLKTYQTFPSGKRVSPQERKKRDCYFEFRA

SEQ ID NO: 10341 - protein, 115 aa, Homo sapiens
MQVMNLNVPMRPGILVQRQSKEVLATPLENRRDMEAEEENQINEKQEPENAGETGQEEDDGLQKIHTSVTRTPSVVESQKRPLKGVTFSREVIVVDLGNEYPTPRSYTREHKERK

SEQ ID NO: 10342 - protein, 194 aa, Homo sapiens
MSLLAKPMSFETTAITFFIILLICLICILLLLVVFLYKCFQGRKGKETKKVPCTDANGGVDCAAAKVVTSNPEDHERILMQVMNLNVPMRPGILVQRQSKEVLATPLENRRDMEAEEENQINEKQEPENAGETGQEEDDGLQKIHTSVTRTPSVVESQKRPLKGVTFSREVIVVDLGNEYPTPRSYTREHKERK

SEQ ID NO: 10343 - protein, 126 aa, Homo sapiens
MAPGEVTITVRLIRSFEHRNFKPVVYHGVNLDQTVKEFIVFLKQDIPLRTNLPPPFRNYKYDALKIIHQAHKSKTNELVLSLEDDERLLLKEDSTLKAAGIASETEIAFFCEEDYKNYKANPISSW

SEQ ID NO: 10344 - protein, 126 aa, Homo sapiens; identical to SEQ ID NO: 10343

SEQ ID NO: 10345 - protein, 126 aa, Homo sapiens; identical to SEQ ID NO: 10343

SEQ ID NO: 10346 - protein, 126 aa, Homo sapiens; identical to SEQ ID NO: 10343

SEQ ID NO: 10347 - protein, 552 aa, Homo sapiens
MDTSSEMLVRFGRRCGRAKESTEIRNSEEDQVLYLPLLPSKVDLQQVTIIPHDEWKRIQDSLDRLTREAACLRAERKAKKEMHLRSQEVVKHWTNTYAGMKEQKLEAKKKRDEEIEAERQILDLEEEIYKQGKRKKAIENAKQYQFYQTERVKNFHSGLLLSRVMKERDAQIEFRKSKIKSDKKWEEQLKLNIEKAFKEEQEKAEKRHRERVALAKDHLKQIKEHEEEEERRKKYEEKDAEEIKRQNALYEIEMRKKLEKKREEMHESRRRFLEHMQDKHIIKAVEQQQQEEEDEKMRKFIKAKKRLIQMGKEKEAETHRLMEKRRERIHNFLSELLKEKLDNEDMIIARDIAEAEAEWEKREREKDEKNKAELKTIAEYRAIVMKNKEEEERQRKIEAKEQLLAVMKADQIFWEHEKEKKCKADKEHQEVQDAHIQQMAKNKFNAKQAKQAELDYCRLTEALVAEKEKEFQDYAREVIELESETTNKYIYPLVKAVQEGPGGGRGPVFVDRGGLRPSYQANDVTGVQLPFYNSQGPKYNFQKSKRRLGFTW

SEQ ID NO: 10348 - protein, 892 aa, Homo sapiens
MHWLASATQTSASIVSSSLLSAVDVSSSLTMSEYFQNTSLPGTANSRQFSLPVVSNAAFLTGSISNFSRASAPAISSAWLQPSASGTSFQPLMGSAYLYQHSSTTMLSGVTGQSHICTSAASYPGVFEWDSTASTVKKSSSLRDFTVTVIDQNTAVSSMSMTAQYYKTSDTNTMVPLYPSLSASLVQGTLTQIPNQQGHNLSLPCQIGSQVYYYNQGTLGPQLSCLQSYGSVSYTGYRASAHQPEMVMVLKEVQPTNVLPPVSTSGMYYSVSSQPITETSVQVMETSLGMDTSLGLQSPSQTFCLPQTPEFSKSFSSRNTQTLESNPSPELGDISITPVQSPTNLLTLSPAPSQEKNENENLDEIKTNLSRNQDPPLLPVEIPDIHPLLACIDPLGQEEQPGSENANLRNKSLSLEDQGIFENGIESSSDLADITTWVEDTYLPPIFSSLQDLDQPEKSCVIKGHSDQVRKNKHKASEPIQGAPKAKIQPKNPECLLEREVVVGSATVSNSASVNKAKHSSNKPHKAASSRISKTKSHGQEKTKGNRKNSSKKSEESKQSGKKVKVEEKQTIPNMKRKKNQPELSQKTLKKPRSSLGMHMLESVQVFHALGKKIDMKTGFSSSRTLGSSSNTQNRQPFPALKPWLDIQHEGKGPEKIQVKAQKLDGSAEKECTSPSHSELPPPGKVKLIPLPFLTLDQPQARHVSRRPNPLASRRPAVAYPARPDSTNSAQSNAVNPSRPAPTNTSLTGPATPAQPISAKATQPSSANPTQPTVPQSAASRPSAYKTSSCSSLQREPVSTAVTSLRSLPKPQNQFLIQDFSLQPRPWRKPTVPEPVMSTPITEEQRPEREAMKRKAQQERENAAKYTSLGKVQFFIERERDMEIAEYYGYTI

SEQ ID NO: 10349 - protein, 922 aa, Homo sapiens
MHWLASATQTSASIVSSSLLSAVDVSSSLTMSEYFQNTSLPGTANSRQFSLPVVSNAAFLTGSISNFSRASAPAISSAWLQPSASGTSFQPLMGSAYLYQHSSTTMLSGVTGQSHICTSAASYPGVFEWDSTASTVKKSSSLRDFTVTVIDQNTAVSSMSMTAQYYKTSDTNTMVPLYPSLSASLVQGTLTQIPNQQGHNLSLPCQIGSQVYYYNQGTLGPQLSCLQSYGSVSYTGYRASAHQPEMVMVLKEVQPTNVLPPVSTSGMYYSVSSQPITETSVQVMETSLGMDTSLGLQSPSQTFCLPQTPEFSKSFSSRNTQTLESNPSPELGDISITPVQSPTNLLTLSPAPSQEKNENENLDEIKTNLSKPLDVHQILIGNQDPPLLPVEIPDIHPLLACIDPLGQEEQPGSENANLRNKSLSLEDQGIFENGIESSSDLADITTWVEDTYLPPIFSSLQDLDQPESPSAKKAKDTSAIKVNQVQEKSCVIKGHSDQVRKNKHKASEPIQGAPKAKIQPKNPECLLEREVVVGSATVSNSASVNKAKHSSNKPHKAASSRISKTKSHGQEKTKGNRKNSSKKSEESKQSGKKVKVEEKQTIPNMKRKKNQPELSQKTLKKPRSSLGMHMLESVQVFHALGKKIDMKTGFSSSRTLGSSSNTQNRQPFPALKPWLDIQHEGKGPEKIQVKAQKLDGSAEKECTSPSHSELPPPGKVKLIPLPFLTLDQPQARHVSRRPNPLASRRPAVAYPARPDSTNSAQSNAVNPSRPAPTNTSLTGPATPAQPISAKATQPSSANPTQPTVPQSAASRPSAYKTSSCSSLQREPVSTAVTSLRSLPKPQNQFLIQDFSLQPRPWRKPTVPEPVMSTPITEEQRPEREAMKRKAQQERENAAKYTSLGKVQFFIERERDMEIAEYYGYTI

SEQ ID NO: 10350 - protein, 193 aa, Homo sapiens
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSVKSRKVTTNKNATSISAKEANATEWKSSQRFSDTQPKHKVT

SEQ ID NO: 10351 - protein, 66 aa, Homo sapiens
MERRLIKKEMKKLLGDYIGIRLRENEFDPKGRRQLTFLDDMAHYDLAISVALQWLDPSEDLTWLEW

SEQ ID NO: 10352 - protein, 588 aa, Homo sapiens
MEMQSPIVQRQERQVRDRGVTRSKAEKVRPPTVPVPQVDIVPGRLSEAEWMALTALEEGEDVVGDILADLLARVMDSAFKVYLTQQCIPFTISQAREAMLQITEWRFLARDEGESAVAEDPTWGEDEEPSACTTDSWAQGSVPVLHASTSEGLENFQGEDPGGVDRIPLGRSWMGRGSQEQMESWEPSPQLRVTSAPPPTSELFQEAGPGGPVEEADGQSRGLSSAGSLSASFQLSVEEAPADDADPSLDPYLVASPQASTGRGHPLGFHLSLEDLYCCMPQLDAAGDRLELRSEGVPCIASGVLVSYPSVGGATRPSASCQQQRAGHSDVRLSAHHHRMRRKAAVKRLDPARLPCHWVRPLAEVLVPDSQTRPLEAYRGRQRGEKTKARAEPQALGPGTRVSPAAFFPLRPGIPFRDLDSGPALLFPTLNLGLSSPSLESKLPLPNSRIRFLTTHPVLPDVARSRSPKLWPSVRWPSGWEGKAELLGELWAGRTRVPPQGLELADREGQDPGRWPRTTPPVLEATSQVMWKPVLLPEALKLAPGVSMWNRSTQVLLSSGVPEQEDKEGSTFPPVEQHPIQTGAPKPR

SEQ ID NO: 10353 - protein, 20 aa, Homo sapiens
MASCLALRMALLLVSGVLAP

SEQ ID NO: 10354 - protein, 150 aa, Homo sapiens
MEDYALTFGINPFIALMIQPIVTMTVVDNQGLGLPVDIQHKAKPSPKASQMLPPDLGPPSFQNLLSPSEKLEPWDPGMRKLTVQTCGLTFIHPAGHGLCHPTAEASAETLSSTALNRPSVREGACNEKSTENKKPQDSVLWSHSRWFQGN

SEQ ID NO: 10355 - protein, 96 aa, Homo sapiens
MEDYALTFGINPFIALMIQPIVTMTVVDNQGLGLPVDIQHKAKPSPKASQMLPPDLGPPSFQNCFTCRTAPSLVMVLSWKSGVRREVPVHPSYAKY

SEQ ID NO: 10356 - protein, 206 aa, Homo sapiens
MAATKTASYDEHFRPEKLREWPEPESVSLMEVLAREDIDEAVCAILFKENSIVKVTVPPFVDPLFQRQQEVDEERRTGLQCETGKRHSIKELEEIEKARLHASSPYFTFTSHCVIPKEWHKASARARSKTYKYSPEKLIYADKKQKRKEKKTADLSQAAFERQFLSSKLSQKNKVGERKGLVSRGLGRGWHAGLCSTHEQHILVPE

SEQ ID NO: 10357 - protein, 95 aa, Homo sapiens
MGCMKSKQTFPFPTIYEGEKQHESEEPFMPEERCLPRMASPVNVKEEVKEPPGTNTVILEYAHRLSQDILCDALQQWACNNIKYHDIPYIESEGP

SEQ ID NO: 10358 - protein, 95 aa, Homo sapiens; identical to SEQ ID NO: 10357

SEQ ID NO: 10359 - protein, 67 aa, Homo sapiens
MGCMKSKQTFPFPTIYEGEKQHESEEPFMPEERCLPRMASPVNVKEEVKEPPGTNTVILEYAHRLSQ

SEQ ID NO: 10360 - protein, 95 aa, Homo sapiens; identical to SEQ ID NO: 10357

SEQ ID NO: 10361 - protein, 95 aa, Homo sapiens; identical to SEQ ID NO: 10357

SEQ ID NO: 10362 - protein, 30 aa, Homo sapiens
MGCMKSKQTFPFPTIYEGEKQHESEEPFMP

SEQ ID NO: 10363 - protein, 131 aa, Homo sapiens
MVRMSRPLFLDWAWRPLCSPSQSLPLTYGPEGWILQWKGTCRQQTALHCPFDFPQAPLRGRHTLSQVPNKGHEKASAVQLPEKQGTDQSRRGPTSAVTKARTSYPESETFIVYLCSYFWNSSKGVYMSGST

SEQ ID NO: 10364 - protein, 292 aa, Homo sapiens
MKSEAKDGEEESLQTAFKKLRVDASGSVASLSVGEGTGVRAPVRTATDDTKPKTTCASKDSWHGSTRKSSRGAVRTQRRRRSKSPVLHPPKFIHCSTIASSSSSQLKHKSQTDSPDGSSGLGISSPKEFSAGESSTSLDANHTGAVVEPLRTSVPRLPSESKKEDSSDATQVPQASLKASDLSDFQSVSKLNQGKPCTCIGKECQCKRWHDMEVYSFSGLQSVPPLAPERRSTLEDYSQSLHARTLSGSPRSCSEQARVFVDDVTIEDLSGYMEYYLYIPKKMSHMAEMMYT

SEQ ID NO: 10365 - protein, 292 aa, Homo sapiens; identical to SEQ ID NO: 10364

SEQ ID NO: 10366 - protein, 175 aa, Homo sapiens
MGQVVYVPVKTGSGADGLSEPEGISLKRVAVVEDFFDIIYSMHVESSAEPGKAPKHAGQKKTYRAIAETYAFLPREAVTRFLMSCTECQKRMHFNSNGLEPKENEPPSPLVSGIIDYNMPLTSTYLKQMKLRVMNSQEQCLPSGAEDIMSGGPTLEAAEFDDLIGKCLPDRPIAE

SEQ ID NO: 10367 - protein, 91 aa, Homo sapiens
MSDSTWMSADPHLASSLSPSQDERMRSPQNLHSQEDGPHRLSHLSQGLNIICSLDTSLRARNPRVSAERNDFSFRGRSRCVTSNSLAKDGY

SEQ ID NO: 10368 - protein, 436 aa, Homo sapiens
MSDSTWMSADPHLASSLSPSQDERMRSPQNLHSQEDDDSSSESGSGNGSSTLNPSTSSSTQGDPAFPEMNGNGAVAPMDFTTAAEDQPINLCDKLPPATALGTASYPSDGCGADGLRSRVKYGVKTTPESPPYSSGSYDSIKTEVSGCPEDLTVGRAPTADDDDDDHDDHEDNDKMNDSEGMDPERLKAFNMFVRLFVDENLDRMVPISKQPKEKIQAIIESCSRQFPEFQERARKRIRTYLKSCRRMKKNGMEMTRPTPPHLTSAMAENILAAACESETRKAAKRMRLEIYQSSQDEPIALDKQHSRDSAAITHSTYSLPASSYSQDPVYANGGLNYSYRGYGALSSNLQPPASLQTGNHSNGPTDLSMKGGASTTSTTPTPTPSSTSTSRPVPTAQLSPTEISAVRQLIAGYRESAAFLLRSADELENLILQQN

SEQ ID NO: 10369 - protein, 81 aa, Homo sapiens
MSCTECQKRMHFNSNGLEPKENEPPSPLVSGIIDYNMPLTSTYLKQMKLRVMNSQEQPSSLSPAPGFVNTVITVLICAHEE

SEQ ID NO: 10370 - protein, 113 aa, Homo sapiens
MKLRVMNSQEQDETSVSSEDFDMSDSTWMSADPHLASSLSPSQDERMRSPQNLHSQEDGPHRLSHLSQGLNIICSLDTSLRARNPRVSAERNDFSFRGRSRCVTSNSLAKDGY

SEQ ID NO: 10371 - protein, 155 aa, Homo sapiens
MHVESSAEPGKAPKHAGQKKTYRAIAETYAFLPREAVTRFLMSCTECQKRMHFNSNGLEPKENEPPSPLVSGIIDYNMPLTSTYLKQMKLRVMNSQEQDETSVSSEDFDMSDSTWMSADPHLASSLSPSQDERMRSPQNLHSQEDGGVCLQGPTA

SEQ ID NO: 10372 - protein, 398 aa, Homo sapiens
MSDSTWMSADPHLASSLSPSQDERMRSPQNLHSQEDDDSSSESGSGNGSSTLNPSTSSSTQGDPAFPEMNGNGAVAPMDFTTAAEDQPINLCDKLPPATALGTASYPSDGCGADGLRSRVKYGVKTTPESPPYSSGSYDSIKTEVSGCPEDLTVGRAPTADDDDDDHDDHEDNDKMNDSEGMDPERLKAFNMFVRLFVDENLDRMVPISKQPKEKIQAIIESCSRQFPEFQERARKRIRTYLKSCRRMKKNGMEMTRPTPPHLTSAMAENILAAACESETRKAAKRMRLEIYQSSQDEPIALDKQHSRDSAAITHSTYSLPASSYSQDPVYANGGLNYSYRGYGALSSNLQPPASLQTGNHSNGPTDLSMKGGASTTSTTPTPRLGAPLTRRWGCSSV

SEQ ID NO: 10373 - protein, 76 aa, Homo sapiens
  MOD_RES (1)..(1): Any amino acid
XQKRMHFNSNGLEPKENEPPSPLVSGIIDYNMPLTSTYLKQMKLRVMNSQEQPSSLSPAPGFVNTVITVLICAHEE

SEQ ID NO: 10374 - protein, 871 aa, Homo sapiens
RICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKLPLRFQRLGHLVALMALLCGDPQEKVAEEAAEGIHSLLHITLRLKYITHDKKDQQNLKRALTKCREFLELHSSAAKCFYNCPFRIAQVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFEKKCKGKINILEQTLMYSKNPKLPIRRSAVLFVGLLSKYMDHNELRRMGTDWIEDDLRDLLCDPEPSLCIIASQTLLLVQMARAEPKPKQRVNWLQKLMGRSSA

SEQ ID NO: 10375 - protein, 1069 aa, Homo sapiens
  MOD_RES (1)..(1): Any amino acid
XVAGTPTSSQPSFGPSIRERPSQSLCPCPCPAGEGDPAWPALERRLVTSRGRQPSPQSHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFEKKCKGKINILEQTLMYSKNPKLPIRRSAVLFVGLLSKYMDHNELRRMGTDWIEDDLRDLLCDPEPSLCIIASQTLLLVQMARAEPKPKQRVNWLQKLMGRSSA

SEQ ID NO: 10376 - protein, 629 aa, Homo sapiens
  MOD_RES (1)..(1): Any amino acid
XQPRQVAGTPTSSQPSFGPSIRERPSQSLCPCPCPAGEGDPAWPALERRLVTSRGRQPSPQSHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAVSP

SEQ ID NO: 10377 - protein, 1042 aa, Homo sapiens
MPLSRRGRGSRLAGSRAATSNLPRATALSPKHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFEKKCKGKINILEQTLMYSKNPKLPIRRSAVLFVGLLSKYMDHNELRRMGTDWIEDDLRDLLCDPEPSLCIIASQTLLLVQMARAEPKPKQRVNWLQKLMGRSSA

SEQ ID NO: 10378 - protein, 670 aa, Homo sapiens
  MOD_RES (1)..(1): Any amino acid
XCNTECLYRQTFQAFSEMLQSLVVKDPHLENLDTIIKLPLRFQRLGHLVALMALLCGDPQEKVAEEAAEGIHSLLHITLRLKYITHDKKDQQNLKRALTKCREFLELHSSAAKCFYNCPFRIAQVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFEKKCKGKINILEQTLMYSKNPKLPIRRSAVLFVGLLSKYMDHNELRRMGTDWIEDDLRDLLCDPEPSLCIIASQTLLLVQMARAEPKPKQRVNWLQKLMGRSSA

SEQ ID NO: 10379 - protein, 600 aa, Homo sapiens
  MOD_RES (1)..(1): Any amino acid
XHPSPRHQPRQVAGTPTSSQPSFGPSIRERPSQSLCPCPCPAGEGDPAWPALERRLVTSRGRQPSPQSHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAVSP

SEQ ID NO: 10380 - protein, 24 aa, Homo sapiens
MRQEVFVTIADLSYQDVHLLLGSE

SEQ ID NO: 10381 - protein, 34 aa, Homo sapiens
MRQEVFVTIADLSYQDVHLLLGSEDRAELFSLTI

SEQ ID NO: 10382 - protein, 932 aa, Homo sapiens
AGSRAATSTSRGALSQSHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAATDALYEVFLGNRLRAATFRLFPQLLMTLLIQIHHSIGLTMSDVDIPSGLYTEQEVPSEVTPLCFAMQATKTLLLRTCCLQEFNIMEKNKGWALLGGKDGHLQGLFLLANALLERNQLLAQKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEESRQVLTICAQFLKWKLPQEVYSKDPWHIKPTEAGTICRFFGKKVQGEN

SEQ ID NO: 10383 - protein, 153 aa, Homo sapiens
MGNYSSHKRTKAPKQARKERPADMDKAWWKSFLNHLTRKKPATRIVLILPLDKRQPLANAGQRIDYASGAGLGSPAAPRLRGAGEGSEREPRMPVLLLLRRQEARRPEEGGARAALSWPRLLSRFRSPGKAPREAGPAEEQPRKRCRCPRPQL

SEQ ID NO: 10384 - protein, 664 aa, Homo sapiens
MESFMESLNRLKEIHEKEVLGLQNKLLELNSERCRDAQRIEELFSKNHQLREQQKTLKENLRVLENRLRAGLCDRCMVTQELARKRQQEFESSHLQNLQRIFILTNEMNGLKEENETLKEEVKRLRGLGDRPKPRAKEGTSDPPSPLLLPSPGGWKAITEKPPGGHEEAEEDHQGVGLRGEEKPAGHRTSPVAKISPGATLPESRAPDMSPQRISNQLHGTIAVVRPGSQACPADRGPANGTPPPLPARSSPPSPAYERGLSLDSFLRASRPSAMTHEAPKLSPKVDRLCLLNRPLSLHLQSPHSSPLAPAAAPSDPRLQDLKAREAEAWEEPTELLGLPSALAGMQDLRLEGALHLLLAQQQLRARARAGSVRPRGQPTPGEMLPSLPVGSDSEGPENEGTRAALAAAGLSGGRHTQPAGPGRAQRTEAAATQDCALDKPLDLSEWGRARGQDTPKPAGQHGSLSPAAAHTASPEPPTQSGPLTRSPQALSNGTKGTRVPEQEEASTPMDPSRPLPGSQLSLSSPGSTEDEDTGRPLPPPHPQPPPHPQPPDLDGHPEPSKAEVLRPESDELDETDTPGSEVGLSSQAEATTSTTGEGPECICTQEHGQGPPRKRKRASEPGDKASKKPSRGRRKLTATEGPGSPRDAEDHSPSPNSSPWEET

SEQ ID NO: 10385 - protein, 572 aa, Homo sapiens
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLSEYSPMERFKEFQIKSYPLQDFSSLKLPHLKKAWGLQGTSFSRKIRTSGDTLPKMLGPKIQSRPAQSIKCAMINIKPGELPKEAAVGAYVKVHTVEQGEILAFLPEGECDTRPLILMSLGNELIRIRKEIFYELIDNDDEMIKKLLKLNIAFPSDEDMCQKFLQQNSWNIFRKDLLQLLVEPCQSQLFTPNRPKKREIYNPKSVVLDLCSINKTTKPRYPIFMAPQKYLPPLRIVQAIKAPRYKIRELLA

SEQ ID NO: 10386 - protein, 576 aa, Homo sapiens
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLSEYSPMERFKEFQIKSYPLQDFSSLKLPHLKKAWGLQGTSFSRKIRTSGDTLPKMLGPKIQSRPAQSIKCAMINIKPGELPKEAAVGAYVKVHTVEQGEILGLHQAFLPEGECDTRPLILMSLGNELIRIRKEIFYELIDNDDEMIKKLLKLNIAFPSDEDMCQKFLQQNSWNIFRKDLLQLLVEPCQSQLFTPNRPKKREIYNPKSVVLDLCSINKTTKPRYPIFMAPQKYLPPLRIVQAIKAPRYKIRELLA

SEQ ID NO: 10387 - protein, 423 aa, Homo sapiens
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLSEYSPMERFKEFQIKSYPLQDFSSLKLPHLKKAWGLQGTSFSRKIRTSGDTLPKMLGPKIQSRPAQSIKCAMINIKPGELPKEAAVGAYVKVHTVEQGEIL

SEQ ID NO: 10388 - protein, 433 aa, Homo sapiens
MEYEVKKGKKGFVSPIRRLVFPKAGRRAACRSSVSRRPLHSMPLYPPDYLIDPQILLCDYLEKEVKFLGHLTWVTSSLNPSSRDELLQLLDTARQLKELPLKTTAEQDSILSLSARCLLLTWRDNEELILRIPTHEIAAASYLQDDALHLLVLKTGLGVDPVPAGVDASPGGAGRDPGPPGGAPEKRRVGTAERRHTICSLDWRMGWGGGAAEARAGGGGGGSLERQRAGARASGSWERRQTFSGSWERRHGGGGGGGGAGKPGGSWERRQAGSGGGGSWERRHPGPNPLDPQDPSPDAYCNLVILAVANRDAAEESCALICQVFQIIYGDQSIECVDRAGYHYTSTPERPWLCSRIMAPRTPLKHVTAARPHLLSMAPTAAAATTAVWAWSSYRITWSRCGVSWGPSRSSSLRCCCGSTGWGCPSRTIAQAC

SEQ ID NO: 10389 - protein, 571 aa, Homo sapiens
MEYEVKKGKKGFVSPIRRLVFPKAGRRAACRSSVSRRPLHSMPLYPPDYLIDPQILLCDYLEKEVKFLGHLTWVTSSLNPSSRDELLQLLDTARQLKELPLKTTAEQDSILSLSARCLLLTWRDNEELILRIPTHEIAAASYLQDDALHLLVLKTGLGVDPVPAGVDASPGGAGRDPGPPGGAPEKRRVGTAERRHTICSLDWRMGWGGGAAEARAGGGGGGSLERQRAGARASGSWERRQTFSGSWERRHGGGGGGGGAGKPGGSWERRQAGSGGGGSWERRHPGPNPLDPQDPSPDAYCNLVILAVANRDAAEESCALICQVFQIIYGDQSIECVDRAGYHYTSTPERPWLCSRSESCHTDGTYAYDADFSCCSSFNGSQDTFEACYSGTSTPSFHGSHCSGSDHSSLGLEQLQDYMVTLRSKLGPLEIQQFAMLLREYRLGLPIQDYCTGLLKLYGDRRKFLLLGMRPFIPDQDIGYFEGFLEGVGIREGGILTDSFGRIKRSMSSTSASAVRSYDGAAQRPEAQAFHRLLADITHDIEALAPDDDDDDEDEPRGSRGGSDAAEDNYL

SEQ ID NO: 10390 - protein, 235 aa, Homo sapiens
MEYEVKKGKKGFVSPIRRLVFPKAGRRAACRSSVSRRPLHSMPLYPPDYLIDPQILLCDYLEKEVKFLGHLTWVTSSLNPSSRDELLQLLDTARQLKELPLKTTAEQDSILSLSARCLLLTWRDNEELILRIPTHEIAAASYLQDDALHLLVLKTGLGVDPVPAGVDASPGGAGRDPGPPGGAPEKRRVGTAERRHTICSLDWRMGWGGGAAEAPTRSTRRTPAPTPTATWSSWL

SEQ ID NO: 10391 - protein, 324 aa, Homo sapiens
ERRHGGGGGGGGAGKPGGSWERRQAGSGGGGSWERRHPGPNPLDPQDPSPDAYCNLVILAVANRDAAEESCALICQVFQIIYGDQSIECVDRAGYHYTSTPERPWLCSRSESCHTDGTYAYDADFSCCSSFNGSQDTFEACYSGTSTPSFHGSHCSGSDHSSLGLEQLQDYMVTLRSKLGPLEIQQFAMLLREYRLGLPIQDYCTGLLKLYGDRRKFLLLGMRPFIPDQDIGYFEGFLEGVGIREGGILTDSFGRIKRSMSSTSASAVRSYDGAAQRPEAQAFHRLLADITHDIEALAPDDDDDDEDEPRGSRGGSDAAEDNYL

SEQ ID NO: 10392 - protein, 99 aa, Homo sapiens
MDTGSREAAFTRDLPRKPADAQVSPEMSITHKEKENAHLKEILLFVNAEAFSQPQPHSAPVCEGQQLTGKFSTSVLTRAGGDASPCSWERLLCYGWSHC

SEQ ID NO: 10393 - protein, 99 aa, Homo sapiens; identical to SEQ ID NO: 10392

SEQ ID NO: 10394 - protein, 117 aa, Homo sapiens
MPSCSCALMAPCGPAAGPAAVERTQQVARGEPGSARGQLQVSPEMSITHKEKENAHLKEILLFVNAEAFSQPQPHSAPVCEGQQLTGKFSTSVLTRAGGDASPCSWERLLCYGWSHC

SEQ ID NO: 10395 - protein, 149 aa, Homo sapiens
MLSGPHPSPTFRPNPCPWPCLHSLWMEISPTQLCFLSPGPSPQSPSCCFQGMNSGSELGKLWRKLFKGIPRLSVSHFDFYCGTCVLLGRPQIPQGSSLGNDIDQYPVVFRNASDQGSWMQLEMLLRKLSDLVWTSDALSDKILEDGLVP

SEQ ID NO: 10396 - protein, 202 aa, Homo sapiens
MKRWQIFVLWVFWVLILWLMTPYLDLTPESAPQEKRMYLVPQHCDCPWFSSGKCGCPSETLNCSSCHHTADEWNWLDACSRKTMGYLMRTRESMTSDTVLWWLGMNSGSELGKLWRKLFKGIPRLSVSHFDFYCGTCVLLGRPQIPQGSSLGNDIDQYPVVFRNASDQGSWMQLEMLLRKLSDLVWTSDALSDKILEDGLVP

SEQ ID NO: 10397 - protein, 383 aa, Homo sapiens
MNAGPSWNKVQHSKNSSGKRQSKSQVPHASSQPRSSLTAVTQPTEEKLKESISPEARRKRNPLGSRCQGASGNKLFLDFQSMKIIKENADEDSASDLSDSERIPIPPSPLTPPDLNLRAEEIDPVYFDLHPGQGHTKPEYYYPNFLPSPFSSWDLRDMALLLNAENKTEAVPRVGGLLGKYIDRLIQLEWLQVQTVQCEKAKGGKARPPTAPGTSGALKSPGRSKLIASALSKPLPHQEGASKSGPSRKKAFHHEEIHPSHYAFETSPRPIDVLGGTRFCSQRQTLEMRTEEKKKKSSKSTKLQRWDLSGSGSSSKVETSGHIRVPKQAAVILDSADSCKASKTQAHAHPRKKGKAESCGHATVSSEKKLKTNGVKQNTYKLK

SEQ ID NO: 10398 - protein, 383 aa, Homo sapiens; identical to SEQ ID NO: 10397

SEQ ID NO: 10399 - protein, 48 aa, Homo sapiens
MNAGPSWNKVQHSKNSSGKRQSKSQVPHASSQPRSSLTAVTQPTEEKL

SEQ ID NO: 10400 - protein, 50 aa, Homo sapiens
MDILLDLGWHFSNCDEDTFYSPVQNTEGDLLFFDHNLKTDRGHVERSVMD

SEQ ID NO: 10401 - protein, 41 aa, Homo sapiens
DLGWHFSNCDEDTFYSPVQNTEGDLLFFDHNLKTDRGHVER

SEQ ID NO: 10402 - protein, 318 aa, Homo sapiens
MSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTKIQLLLLGDLLEQLDHGRAELDALLRSPDPRPFLADWALVERRLADVSAVMDSFLTMMVPGRLHVKHRLVSDVSATKIPHIWLMLSTKMPVVFDRKASAAHQDWARLRWFVTIQPATSEQYELRFRLLDPRTQQECAQCGVIPVAACTFDVRNLLPNRSYKFTIKRAETSTLVYEPWRDSLTLHTKPEPLEGPALSHSV

SEQ ID NO: 10403 - protein, 318 aa, Homo sapiens; identical to SEQ ID NO: 10402

SEQ ID NO: 10404 - protein, 205 aa, Homo sapiens
MAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASVCKCLSQKITQLRGQESQKYALRSFQMARVIFNRDGCSVLQRHSRDTHFYPLEEGSTSLDDEKPNPGLSKDITHFLLQQNVMKDL

SEQ ID NO: 10405 - protein, 151 aa, Homo sapiens
MAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASVCKCLSQKITQLRGQESQKYALRQQNVMKDL

SEQ ID NO: 10406 - protein, 62 aa, Homo sapiens
MAARDATSGSLSEESSALDLPSACDIRDYVLQGPSQEANSEAFSSLEFHSFPYSSDVDPADL

SEQ ID NO: 10407 - protein, 200 aa, Homo sapiens
MESHSCSPSWSTMTISAHCNLRLPSASQSVGITGVSHHIWPRIFYMTMAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASVCKCLSQKITQLRGQESQKYALRSFQMARVIFN

SEQ ID NO: 10408 - protein, 121 aa, Homo sapiens
MAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASV

SEQ ID NO: 10409 - protein, 106 aa, Homo sapiens
MEVCSCCPGWSATVSAHCNLRFASSTSQSAGITGMSQCAWPTFTFLTMAARDATSGSLSEESSALDLPSACDIRDYVLQGPSQEANSEAFSSLEFHSFPYSSDVDP

SEQ ID NO: 10410 - protein, 126 aa, Homo sapiens
MVALFQHSPYWQADGYGHSHRLKCQHFKQHRQYNDKLEISSNLGPQFNALLNILLNIVHPTLSHDTRRSKGLKIEGLLQSRELGNSWTVTMCIWVLKALQSSAPNKPLDWLDPMPCFQNLLARGTP

SEQ ID NO: 10411 - protein, 240 aa, Homo sapiens
MPPPAKEGGRKGPRERSGKSAPGTAQGEERAKGAPATEPPKPGWALTPQGLAAMLPAQRHRHLLFGDLLEDVGAAASTFPCGSVEPGYRMPDPRPWTQSLELPAERQNRLLGVLKAAEARGRVRALRLRYTRMRAEEIALLIQRQKSARAAIRLELFLPPQLKPARIPDPLDRQEVQTSPGRGGERGGALPASAHAGPQPLSPAAEARGDHPGGERGWHHLPAVTATESVRRAPASHIKL

SEQ ID NO: 10412 - protein, 122 aa, Homo sapiens
MYKSKIPRAQNQVSVKVTPKNTEMKIAEEPSPSLGQTLEWLRKELSEMQIQDQSLLLTLRHLHSVLEELRADSAHWEDARSSGGTSPIRARAGSEGRGCQPVCSRGLAQLLRGEDSRRSSLP

SEQ ID NO: 10413 - protein, 1237 aa, Homo sapiens
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDGTLLQAFVAEVAEQIVGIAVIRNEMDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEGNIIVYGNTIDTYTTVETLLNLGVSGSRIHLVQPPPASTITCINNYSVESAVADALGAAGVTMYRDAILAQWNDGLHPDPIYSASFTTPTKPFRLQCSMFFSFCEKNVDYETFKALNDACLVYDSRLVIDTNFHTNDIAIRAAGSLTKFSNRYYSNEWTHSNFSSKEIGFQLAAAMLHLFDPTLEPVTEPPANLDRLIPMYKGAKIQGGILPGSYHYLHIAKPAIPTPLEVQMAQPNYGLELVTGSAKNGTYFRIHINKYKMVETITCLSREPFPASNYIRLFGQHEQLLNNLCARYDENLITDLYSYFTEPWCLALFHDRFIDLRKELRQILASKEEEDLPSIEQLAHQIEDEEINPTEKPRQYLKRVFEESIYKTLVERSTLDYLHYNRYHLPMYAWPGIV

SEQ ID NO: 10414 - protein, 254 aa, Homo sapiens
MNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVF

SEQ ID NO: 10415 - protein, 1177 aa, Homo sapiens
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPESLDFMNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDGTLLQAFVAEVAEQIVGIAVIRNEMDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEGNIIVYGNTIDTYTTVETLLNLGVSGSRIHLVQPPPASTITCINNYSVESAVADALGAAGVTMYRDAILAQWNDGLHPDPIYSASFTTPTKPFRLQCSMFFSFCEKNVDYETFKALNDACLVYDSRLVIDTNFHTNDIAIRAAGSLTKFSNRYYSNEWTHSNFSSKEIGFQLAAAMLHLFDPTLEPVTEPPANLDRLIPMYKGAKIQGGILPGSYHYLHIAKPAIPTPLEVQMAQPNYGLELVTGSAKNGTYFRIHINKYKMVETITCLSREPFPASNYIRLFGQHEQLLNNLCARYDENLITDLYSYFTEPWCLALFHDRFIDLRKELRQILASKEEEDLPSIEQLAHQIEDEEINPTEKPRQYLKRVFEESIYKTLVERSTLDYLHYNRYHLPMYAWPGIV

SEQ ID NO: 10416 - protein, 200 aa, Homo sapiens
MSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEDGGRASVLFC

SEQ ID NO: 10417 - protein, 145 aa, Homo sapiens
GLRESLFRTPRFGCFSIFPRRIRVEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEVAGFYEFCFQS

SEQ ID NO: 10418 - protein, 189 aa, Homo sapiens
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKAR

SEQ ID NO: 10419 - protein, 470 aa, Homo sapiens
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKNICLGRSS

SEQ ID NO: 10420 - protein, 320 aa, Homo sapiens
MSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEGNIIVYGNTIDTYTTVETLLNLGVSGSRIHLVQPPPASTITCINNYSVESAVADALGAAGVTMYRDAILAQWNDGLHPDPIYSASFTTPTKPFRLQCSGAFFLGLTIICILPSLPFQLPWRYKWHSLIMV

SEQ ID NO: 10421 - protein, 1203 aa, Homo sapiens
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSNFVKMVPFNTCTLEQDLYVFHRAGLLKSINIRFATLLDTPGVENLVSTLMLNKSILEDLDRYNKARKDPDGTLLQAFVAEVAEQIVGIAVIRNEMDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEGNIIVYGNTIDTYTTVETLLNLGVSGSRINNYSVESAVADALGAAGVTMYRDAILAQWNDGLHPDPIYSASFTTPTKPFRLQCSMFFSFCEKNVDYETFKALNDACLVYDSRLVIDTNFHTNDIAIRAAGSLTKFSNRYYSNEWTHSNFSSKEIGFQLAAAMLHLFDPTLEPVTEPPANLDRLIPMYKGAKIQGGILPGSYHYLHIAKPAIPTPLEVQMAQPNYGLELVTGSAKNGTYFRIHINKYKMVETITCLSREPFPASNYIRLFGQHEQLLNNLCARYDENLITDLYSYFTEPWCLALFHDRFIDLRKELRQILASKEEEDLPSIEQLAHQIEDEEINPTEKPRQYLKRVFEESIYKTLVERSTLDYLHYNRYHLPMYAWPGIV

SEQ ID NO: 10422 - protein, 200 aa, Homo sapiens; identical to SEQ ID NO: 10416

SEQ ID NO: 10423 - protein, 470 aa, Homo sapiens; identical to SEQ ID NO: 10419

SEQ ID NO: 10424 - protein, 135 aa, Homo sapiens
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHF

SEQ ID NO: 10425 - protein, 199 aa, Homo sapiens
MAAANKGKCLPGVVGLAQALPVGPGRRAIAAGNKPRVRSIRFAAGHDAEGSHSHVHFDEKLHDSVVMVTQESDSSFLVKVGFLKILHRYEITFTLPPVHRLSKDVREAPVPSLHLKLLSVVPVPEGYSVKCEYSAHKEGVLKEEILLACEGGTGTCVRVTVQARVMDRHHGTPMLLDGVKCVGAELEYDSEHSDWHGFD

SEQ ID NO: 10426 - protein, 133 aa, Homo sapiens
MAAANKGNKPRVRSIRFAAGHDAEGSHSHVHFDEKLHDSVVMVTQESDSSFLVKVGFLKILHRYEITFTLPPVHRLSKDVREAPVPSLHLKLLSVVPVPEDRHHGTPMLLDGVKCVGAELEYDSEHSDWHGFD

SEQ ID NO: 10427 - protein, 174 aa, Homo sapiens
MAAANKGNKPRVRSIRFAAGHDAEGSHSHVHFDEKLHDSVVMVTQESDSSFLVKVGFLKILHRYEITFTLPPVHRLSKDVREAPVPSLHLKLLSVVPVPEGYSVKCEYSAHKEGVLKEEILLACEGGTGTCVRVTVQARVMDRHHGTPMLLDGVKCVGAELEYDSEHSDWHGFD

SEQ ID NO: 10428 - protein, 174 aa, Homo sapiens; identical to SEQ ID NO: 10427

SEQ ID NO: 10429 - protein, 127 aa, Homo sapiens
  MOD_RES (1)..(1): Any amino acid
XNKPRVRSIRFAAGHDAEGSHSHVHFDEKLHDSVVMVTQESDSSFLVKVGFLKILHRYEITFTLPPVHRLSKDVREAPVPSLHLKLLSVVPVPEDRHHGTPMLLDGVKCVGAELEYDSEHSDWHGFD

SEQ ID NO: 10430 - protein, 200 aa, Homo sapiens
MVHAFLIHTLRAPNTEDTGLCRVLYSCVFGAEKSPDDPRPHGAERDRLLRKEQILAVARQVESMCRLQQQASGRPPMDLQPQSSDEQVPLHEAPRGAFRLAAENPFQEPRTVVWLGVLSLGFALVLDAHENLLLAEGTLRLLTRLLLDHLRLLAPSTSLLLRADRIEGILTRFLPHGQLLFLNDQFVQGLEKEFSAAWPR

SEQ ID NO: 10431 - protein, 200 aa, Homo sapiens; identical to SEQ ID NO: 10430

SEQ ID NO: 10432 - protein, 59 aa, Homo sapiens
MVHAFLIHTLRAPNTEDTGLCRVLYSCVFGAEKSPDDPRPHGAERDRLLRKEQILAVAR

SEQ ID NO: 10433 - protein, 86 aa, Homo sapiens
MVHAFLIHTLRAPNTEDTGLCRVLYSCVFGAEKSPDDPRPHGAERDRLLRKEQILAVARQVESMCRLQQQASGRPPMDLQPQSSDE

SEQ ID NO: 10434 - protein, 384 aa, Homo sapiens
MAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGELQFAFVCFLLGNVYEAFEHWKRLLNLLCRSEAAMMKHHTLYINLISILYHQLGEIPADFFVDIVSQDNFLTSTLQVFFSSACSIAVDATLRKKAEKFQAHLTKKFRWDFAAEPEDCAPVVVELPEGIEMG

SEQ ID NO: 10435 - protein, 384 aa, Homo sapiens; identical to SEQ ID NO: 10434

SEQ ID NO: 10436 - protein, 306 aa, Homo sapiens
MGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIMLNGTKEDVDVLKTRMEERRLRAKLEKKTKKPKAAESVSKPDVSEEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 10437 - protein, 336 aa, Homo sapiens
MGCDGGTIPKRHELVKGPKKVEKIWHLKNGKEWCSLHSEGKNKNGKEWDMEYDVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIMLNGTKEDVDVLKTRMEERRLRAKLEKKTKKPKAAESVSKPDVSEEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 10438 - protein, 42 aa, Homo sapiens
MGCDGGTIPKRHELVKGPKKVEKAIIGGLLDGAWSPETPSQD

SEQ ID NO: 10439 - protein, 151 aa, Homo sapiens
MFQVFKPHAGEDYKYPRETETIWSHPYVVEGSHKSPLESLSLHGCLAAMAPSITSSEDSSPSQRDKKDLSLDLLLTRKKRSQGLHWSHWQGLNHMSIRIHTPEQGSPSLGQNWSWGNRKEKGVAQRQVPTTGTHSFFHCTSEGNKEKPHHF

SEQ ID NO: 10440 - protein, 156 aa, Homo sapiens
MWKRSDHQPKIKAEDGPLVGQFEVLGSVPEPAMPHPLELSEFESFPVFQDIRLHIREVGAQLVKKVNAVFQLDITKNGKTILRWTIDLKNGSGDMYPGPARLPADTVFTIPESVFMELVLGKMNPQKAFLAGKFKVSGKVLLSWKLERVFKDWAKF

SEQ ID NO: 10441 - protein, 137 aa, Homo sapiens
MAQKPLSTAAAERMNLVGQDEIWKYRLKAESEARQNWPQNWGFLTTPFEELIKCEEDLPTPKPKIELPERFRIRPVTPVEKYIKVFPSPPVPQTTQGFIGWRSAVPGLNKCLELDDAIRSCKGAFARELCWPKQGVH

SEQ ID NO: 10442 - protein, 408 aa, Homo sapiens
MASKKFAVKCGNFAVLVDLHILPQGSNKDTSWFSEQKKEEVCLLLKETIDSRVQEYLEVRKQHRPSNAEFTRSNPLSLKGYGFQITAYFLKRGIRLRCIRSTQNAELCVFPDRFVVCVSQLAFSRDLLASQNEDLTERVLHGVSDYFAECAESSLPPSAKLRRNALKEIVKRTETKSSVTSKSQTRRDTVETSSDSVIAEIARRRNDGQASSSPPSESMGQAKDSIKAAESHWGLPVQKLEKVNQTQPEDTSGQQKPHPGERLKTGLLSRSPVCSCESASPCPKQSPRVAKTQQKRRNCSSAEDFDHHGRVSLGSDRLVPREIIVEKSKAVRVLPASELSDPGLLLKQDLAKTTSKEELHVLESLSSRHLMKNNPGQAQQTGLATNTERLSTIQNSPTKKRKKYERGH

SEQ ID NO: 10443 - protein, 363 aa, Homo sapiens
MAHVLQKPKHSGTHSIVQEFQVPDYVPWQQSKQETKPSTLPPVQQANSLHTSKMKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREIIDQFEENMPVLRAEVEELQAQTREPREVIFEDVLLRRPKCTPDMDVILNIPVEEPLPF

SEQ ID NO: 10444 - protein, 328 aa, Homo sapiens
MEVLSLPNSFQTQALWDSLHSPGVPGSVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREIIDQFEENMPVLRAEVEELQAQTREPREVIFEDVLLRRPKCTPDMDVILNIPVEEPLPF

SEQ ID NO: 10445 - protein, 256 aa, Homo sapiens
MSYKMFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREVRGQGRWWSL

SEQ ID NO: 10446 - protein, 61 aa, Homo sapiens
MGRADTPRHPPPPAAGFGVHRGAFLIPVALRVLLAGRTPRPFTPGLADPRRLGPRRVQAAQ

SEQ ID NO: 10447 - protein, 74 aa, Homo sapiens
MERAQCLRKGILSFERSLEQRSLILSPRLEYSGAITAHCSLDLLDSTNPPASAFWVVETTDTEDEREKKREITE

SEQ ID NO: 10448 - protein, 79 aa, Homo sapiens
MHHVRQLMMPICPMALNSTTSSSTTFGAFRIMTLNVEEWATAWKVLILLEAAVEEEKRSEEKRILVCGTCGTRSSQKNL

SEQ ID NO: 10449 - protein, 79 aa, Homo sapiens; identical to SEQ ID NO: 10448

SEQ ID NO: 10450 - protein, 108 aa, Homo sapiens
MLAKGAEEGRSGGPRPAITLPGSLHFTCDLKTSPYCLTRAELMEHLPLRVAVHSMSPCHRSCFCGELKRGHPWNTPQVSSFPSSTTSLSHSCTTSHLDCSQQVESGSK

SEQ ID NO: 10451 - protein, 108 aa, Homo sapiens; identical to SEQ ID NO: 10450

SEQ ID NO: 10452 - protein, 322 aa, Homo sapiens
MARSRLPATSLRKPWKLDRQKLPSPDSGHSLLCGWSPGGKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARPRLPAVHHHHHHHHAVWPPGAATVLQPAPSLWTPGPP

SEQ ID NO: 10453 - protein, 95 aa, Homo sapiens
MLDSSAAEQVTRLTLKLLGQKLEQERQNVEGGPEGLHLEPGNEDRPDDALQTALKRRRDLLQRLREATLMHITLEGSSSHGHPARRGACTWPRLA

SEQ ID NO: 10454 - protein, 284 aa, Homo sapiens
GKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARPRLPAVHHHHHHHHAVWPPGAATVLQPAPSLWTPGPP

SEQ ID NO: 10455 - protein, 219 aa, Homo sapiens
MAPPSRHCLLLISTLGVFALNCFTKGQKNSTLIFTRENTIRNCSCSADIRDCDYSLANLMCNCKTVLPLAVERTSYNGHLTIWFTDTSALGHLLNFTLVQDLKLSLCSTNTLPTEYLAICGLKRLRINMEAKHPFPEQSLLIHSGGDSDSREKPMWLHKGWQPCMYISFLDMALFNRDSAFKSYSIENVTSIANNFPDFSYFRTFPMPSNKSYVVTFIY

SEQ ID NO: 10456 - protein, 219 aa, Homo sapiens; identical to SEQ ID NO: 10455

SEQ ID NO: 10457 - protein, 219 aa, Homo sapiens; identical to SEQ ID NO: 10455

SEQ ID NO: 10458 - protein, 219 aa, Homo sapiens; identical to SEQ ID NO: 10455

SEQ ID NO: 10459 - protein, 65 aa, Homo sapiens
MGNPRLPRLLCALKFSGFLSNIRGPLAGEDGMGDTQLARVRDSALKTPWRPAPCPPPAHSLDDWK

SEQ ID NO: 10460 - protein, 297 aa, Homo sapiens
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQEVFEELTHQVQEKDSLASQLHVRHVAIEQLLKNCSKLPCLQVGRTGMKSHLPINN

SEQ ID NO: 10461 - protein, 296 aa, Homo sapiens
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQVFEELTHQVQEKDSLASQLHVRHVAIEQLLKNCSKLPCLQVGRTGMKSHLPINN

SEQ ID NO: 10462 - protein, 242 aa, Homo sapiens
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQ

SEQ ID NO: 10463 - protein, 221 aa, Homo sapiens
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREE

SEQ ID NO: 10464 - protein, 240 aa, Homo sapiens
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADPGMCSTSISNFEEARTSYGTDEDILFVYLDS

SEQ ID NO: 10465 - protein, 127 aa, Homo sapiens
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVE

SEQ ID NO: 10466 - protein, 142 aa, Homo sapiens
MFIKVMFGAGCSVLVNTSCRLVNLTAHLRQKAGLPPDATIALLAEDGNLVSLEEDLKEGASRAQTMGNSLLKERAIYVLVRIISKVAQEGEDMASTRYESLLENLDDHYPELAGANRQQPSRTPLAESGIAEKLHQQEGQGQ

SEQ ID NO: 10467 - protein, 142 aa, Homo sapiens
MFIKVMFGAGCSVLVNTSCRLVNLTAHLRQKAGLPPDATIALLAEDGNLVSLEEDLKEGASRAQTMGNSLLKERAIYVLVRIISKVAQEGEDMASTRYESLLENLDDHYPELAGANRQQPSRTPLAESGIAEKLHQQEGQGP

SEQ ID NO: 10468 - protein, 148 aa, Homo sapiens
MFIKVMFGAGCSVLVNTSCRLVNLTAHLRQKAGLPPDATIALLAEDGNLVSLEEDLKEGASRAQTMGNSLLKERAIYVLVRIIKGEDMASTRYESLLENLDDHYPELAEELRRLSGLSSVGHNWRKRMGTRRGRHEQSPTSRPRKGPD

SEQ ID NO: 10469 - protein, 217 aa, Homo sapiens
MASQKQMEVVTKGTGFRRRPKTITYTPGTCELLRVMMKESKLTNIQQRHIMDIMKRGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQKLREMEDIDHRRSEELRKGLATT

SEQ ID NO: 10470 - protein, 217 aa, Homo sapiens; identical to SEQ ID NO: 10469

SEQ ID NO: 10471 - protein, 217 aa, Homo sapiens; identical to SEQ ID NO: 10469

SEQ ID NO: 10472 - protein, 162 aa, Homo sapiens
MASQKQMEVVTKGTGFRRRPKTITYTPGTCELLRVMMKESKLTNIQQRHIMDIMKRGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELV

SEQ ID NO: 10473 - protein, 120 aa, Homo sapiens
MASQKQMEVVTKGTGFRRRPKTITYTPGTCELLRVMMKESKLTNIQQRHIMDIMKRGDALPLQCSPTSSQRVLPSKQIASPIYLPPILAARPHLRPANMCQANGAYSREQFKPQATRDLE

SEQ ID NO: 10474 - protein, 138 aa, Homo sapiens
MPASATAAWHCPPLCLPPLPASAPTSPPNPATRPAPGPGRRARCPQSAHPAPTRGALTFWAPGSWPRVLLVPRSPGPVLRAPRLPHPAARARRRAWHGARLPGSPARAGRTFQRGLVSNSWAHAIFLPRPPNVLELQV

SEQ ID NO: 10475 - protein, 138 aa, Homo sapiens; identical to SEQ ID NO: 10474

SEQ ID NO: 10476 - protein, 364 aa, Homo sapiens
MPRGRCRQQGPRIPIWAAANYANAHPWQQMDKASPGVAYTPLVDPWIERPCCGDTVCVRTTMEQKSTASGTCGGKPAERGPLAGHMPSSRPHRVDFCWVPGSDPGTFDGSPWLLDRFLAQLGDYMSFHFEHYQDNISRVCEILRRLTGRAQAWAAPYLDGDLPLPDDYELFCQDLKEVVQDPNSFAEYHAVVTCPLPLASSQLPVAPQLPVVRQYLARFLEGLALDMGTAPRSLPAAMATPAVSGSNSVSRSALFEQQLTKESTPGPKEPPVLPSSTCSSKPGPVEPASSQPEEAAPTPVPRLSESANPPAQRPDPAHPGGPKPQKTEEEVLETEGDQEVSLGTPQEVVEAPETPGEPPLSPGF

SEQ ID NO: 10477 - protein, 364 aa, Homo sapiens; identical to SEQ ID NO: 10476

SEQ ID NO: 10478 - protein, 364 aa, Homo sapiens; identical to SEQ ID NO: 10476

SEQ ID NO: 10479 - protein, 290 aa, Homo sapiens
MHPINVRRDPSIPIYGLRQSILLNTRLQDCYVDSPALTNIWMARTCAKQNINAPAPATTSSWEVVRNPLIASSFSLVKLVLRRQLKNKCCPPPCKFGEGKLSKRLKHKDDSVMKATQQARKRNFISSKSKQPAGHRRPAGGIRESKESSKEKKLTVRQDLEDRYAEHVAATQALPQDSGTAAWKGRVLLPETQKRQQLSEDTLTIHGLPTEGYQALYHAVVEPMLWNPSGTPKRYSLELGKAIKQKLWEALCSQGAISEGAQRDRFPGRKQPGVHEEPVLKKWPKLKSKK

SEQ ID NO: 10480 - protein, 280 aa, Homo sapiens
MELGHGAGTTTFTRAHLNDKEGQQDLDPWKAAYSSLDTSKFKNQGLSSPQPLPLGASAQGSSLGQCHLKEIPPPPPTAASRDSLGMDPQSRSLKNAGSRSSSRENRATSGEGAQPCQGTDDGPSLGAQDQRSTPTNQKGSIIPNNIRHKFGSNVVDQLVSEEQAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 10481 - protein, 195 aa, Homo sapiens
MDPQSRSLKNAGSRSSSRENRATSGEGAQPCQGTDDGPSLGAQDQRSTPTNQKGSIIPNNIRHKFGSNVVDQLVSEEQAQKAIDEVFEGQKRASSWPSRTQNPVEISSVFSDYYDLGYNMRSNLFRGAAEETKSLMKASYTPEVIEKSVRDLEHWHGRKTDDLGRWHQKNAMNLNLQKALEEKYGENSKSKSSKY

SEQ ID NO: 10482 - protein, 280 aa, Homo sapiens; identical to SEQ ID NO: 10480

SEQ ID NO: 10483 - protein, 183 aa, Homo sapiens
MIVFPETSQPRFLYSLQNYAVRDGLGTILRGGAEEGSYDNWPHTRKSWGPLSPGHQRELWTQPDPWTEVLSGHKGDAGACGCCCFCSQFINARCAHPLCLARGLDRRASEEMPILQALCLLPKENLHDASRRVHRGRGEENVEWTGDLHPAQLGRGGRPEICHSLEAIALVTKARHRKTNTTF

SEQ ID NO: 10484 - protein, 362 aa, Homo sapiens
MCTVDVEGFDDVGETLSDAVRDGLGTILRGGAEEGSYDNWPHTRKSWGPLSPGHQRELWTQPDPWTEVLSGHKGDAGACGCCCFCSQFINARCAHPLCLARGLDRRASEEMPILQALCLLPKVSTPSITVLSPQRSAAPSITVPSPQRSAAPSITVPSPQRSAPRASLCPPHKGQHPEHHCALPPKGQHPEHHCALPTKVSTPSITVPSPQRSPQMSLSSAARGSNTDVAGLSVGEWPGWQLWGEGQDGAQQRPHLPSGGSGAGVAPQRLPKSRACILCSRHGAQGPWVTGRSVSHSHCPIQGLLDLQRPDLGTDWGRTRPLCTPQDLCGGRPLPSTWGVTMHLIHCLSVSLSLCLSLSHCV

SEQ ID NO: 10485 - protein, 142 aa, Homo sapiens
MCRCSLVLLSVDHEVPFSSFFIGWRTEGRAWRAGRPDMADGSGWQPPRPCEAYRAEWKLCRSARHFLHHYYVHGERPACEQWQRDLASCRDWEERRNAEAQQSLCESERARVRAARKHILVWAPRQSPPPDWHLPLPQEKDE

SEQ ID NO: 10486 - protein, 105 aa, Homo sapiens
MADGSGWQPPRPCEAYRAEWKLCRSARHFLHHYYVHGERPACEQWQRDLASCRDWEERRNAEAQQSLCESERARVRAARKHILVWAPRQSPPPDWHLPLPQEKDE

SEQ ID NO: 10487 - protein, 117 aa, Homo sapiens
MCRCSLVLLSVDHEVPFSSFFIGWRTEGRAWRAGRPDMADGSGWQPPRPCEAYRAEWKLCRSARHFLHHYYVHGERPACEQWQRDLASCRDWEERRNAEAQVLSVVAHTCNLSYLGG

SEQ ID NO: 10488 - protein, 251 aa, Homo sapiens
MGSKLTCCLGPSGGLNCDCCRPDVGPCHECEIPETVAATAPASTTAKPAKLDLKAKKAQLMQYLSLPKTPKMLKMSKGLDARSKRWLKIIWRRHGIWPLENIGPTEDVQASAHGGVEENMTSDIEIPEAKHDHRPTEDVQVSAHGGVEENITSDIEISEAKHDHHLVEDLSESLSVCLEDFMTSDLSESLSVSLEDFMTSGLSESLSVSLEDLMTPEMAKERYEDYLCWVKMARSRLNEPISSQVLGLLRL

SEQ ID NO: 10489 - protein, 229 aa, Homo sapiens
MGNILTCCINSHCGWPRGKDAPCYESDTDIYETVAAATSESTTVEPGKLDVGATEGQDLQHISNQKMPTGPPEDRLSLKFLPSSEEDNDDAKILPSPVQGSSEDNLSLVCLPRSEDDDCDDDDDDDAQILPSRVQGGCYRFDSSSCSSEDNLSLVCLPRSEDDDCDDDDDDAQILPSPVQACSEDSLFLRCSLRHKDEEEEDDDDIHITARIESDLTLESLSDEEIHPG

SEQ ID NO: 10490 - protein, 159 aa, Homo sapiens
MEQDWQPGEEVTPGPEPCSKGQAPLYPIVHVTELKHTDPNFPSNSNAVGTSSGWNRIGTGCSHTWDWRFSCTQQALLPLLGAWEWSIDTEAGGGRREQSQKPCSNGGPAAAGEGRVLPSPCFPWSTCQAAIHKVCRWQGCTRPALLAPSLATLKEHSYP

SEQ ID NO: 10491 - protein, 159 aa, Homo sapiens; identical to SEQ ID NO: 10490

SEQ ID NO: 10492 - protein, 128 aa, Homo sapiens
MTSLFAQEIRLSKRHEEIVSQRLMLLQQMENKLGDQHTEKASQLQTVETAFKRNLSLLKDIEAAEKSLQTRIHPLPRPEVVSLETRYWASVEEYIPKWEQFLLGRAPYPFAVENQNEAENTIQNEAQR

SEQ ID NO: 10493 - protein, 128 aa, Homo sapiens; identical to SEQ ID NO: 10492

SEQ ID NO: 10494 - protein, 63 aa, Homo sapiens
MTSLFAQEIRLSKRHEEIVSQRLMLLQQMENKLGDQHTEKASQLQTVETAFKRNLSLLKDIEA

SEQ ID NO: 10495 - protein, 128 aa, Homo sapiens; identical to SEQ ID NO: 10492

SEQ ID NO: 10496 - protein, 128 aa, Homo sapiens; identical to SEQ ID NO: 10492

SEQ ID NO: 10497 - protein, 294 aa, Homo sapiens
MTKGDFIDEEVEDMYLVDFTQKIIDKRKEMEASGAHRDSQKAGEGTTMRKTFLRERSLLPKTPVKNGWITWTLWGVPGLYEKDLPDLLEMDKNLQGRLFISLLMKTLLSEDMRKELQRQQWEEEEREALKRPMGPVHYEDIRENDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 10498 - protein, 467 aa, Homo sapiens
MDRRKKPLDVTASSLVDLKAELFRKQEEFKQEKLLKDSGVFGKPKTTNKKPSIWSKQNVGVSNRAEKDAEQKIEEQKTLDKAREKLEEKAKLYEKMTKGDFIDEEVEDMYLVDFTQKIIDKRKEMEASGAHRDSQKAGERDDDEENLPEGEIPPPQDPSEEWVDYVDSLGRSRRCMRKDLPDLLEMDKNLQGRLFISPANEKTLLSEDMRKELQRQQWEEEEREALKRPMGPVHYEDIRENEARQLGVGYFAFARDKELRNKQMKTLEMLREQTTDQRTKRENIKEKRKAILEARLAKLRQKKMKKSKEGGTEEENRDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 10499 - protein, 141 aa, Homo sapiens
MDSSACKKSHQSKKWRIQAQENFAKKFPYRLSWLTEPDPEPLQPWEVTNDSNTVQLPLQKRLVPTRSIPVRGLGAPDFTSPSGSCPAPLPAPSPPPLCNLWELKLLSRRFPRQLAFLLSTRHTEAACPQTSKAAGLSRGLS

SEQ ID NO: 10500 - protein, 177 aa, Homo sapiens
MAGYQLWSPWTPLDESFQWLRHTTPTPSSKHPFKASPCFPHTPSDLEVQLCFQEVTLVLDSPFLESGVSPKLPCHTSELRTMNNKGLVRKPQPIRLSGVDSVFGRVITAQPPKWTGTFRVSDKSAFCKIISREHQWPIGLKEPQIQMTVTMCKQMLRSILLLYATYKKCTFALQHSK

SEQ ID NO: 10501 - protein, 177 aa, Homo sapiens; identical to SEQ ID NO: 10500

SEQ ID NO: 10502 - protein, 572 aa, Homo sapiens
MDDDYEAYHSLFLSLLGLCPSKTPINENAPVFDPEPVIAHCFKQFQQKDFRLPQTRRRIIMVPRKEDQTPLNPASQPQAPPKPIPSFKVLEARDIQEQPEDRKTWLSQRSKLRQELESFGDVKRWLENKPSITPSEAKVLHMIHEEQSAQPNASQATTRTTRKKAPRLSRLSRQMVPQLQLPEPPALSVMYSYLHSRKIKILEIFHKVGQGENQRITREEFIAAVKAVGVPLKNQEVEDIVIYLSSLGKHNTITMDILANTYKQWSMAQQRSSLATAREHYILAKHRDSLKGPLKKQEVDSAPQLPKVDLLTVPAVDTQMETRPMTLEEMEEVGKRYRERQRQHKLTIPSIQYTEQCHLVRCGNRHFDEHCLPSTIHGDMRELIDSARRHNFLVYLQCWKLCKSYGLPLTEDILMKALLYPGDKIIFQMDKVCPIRQPGGYYSDWKVFSPNLALLRSQGPGKSKRTDKKTPKKSKKMRFKEFEEFTRKLKVKRSSGLQQTHPNSFWPGHLLDKLQLYLPTVATDRSLALFSCVQHQPHVYPATYHPDHWWPLRNKNYMTHAHYDAAKVYYIN

SEQ ID NO: 10503 - protein, 572 aa, Homo sapiens; identical to SEQ ID NO: 10502

SEQ ID NO: 10504 - protein, 279 aa, Homo sapiens
MADDLGDEWWENQPTGAGSSPEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 10505 - protein, 149 aa, Homo sapiens
MKEALHQIVVRCSELVSSTSLPRLSVSRLQGPPDSQPLGTLGQGGWKLLGIVGSLAPETLGGLGTEFGPCTHPLPFDMVRERERDDELRQGWLLQCPQCARTLLCHCGPFLTPPSQTSSSGFQLCSLKPSGSLVTATEPLSNFAFSYFP

SEQ ID NO: 10506 - protein, 536 aa, Homo sapiens
MEEPPQEALAEPLKHESPAAPSSAGHTKGQEEDDQKNQAERKADNHTAHRIADQTALRVPSQAESSIFSQATNGVAEQNGHSTPGQAGRRASNPADVSDLRADDQVNQTPSEQTKGKASSQANNVQHEQSDGQVSGLTEERTAEQTERRLPTQAERRTSGQIDGRLAMPSDQRGSRQTDHRMAGQSERRASEQMDRRMSGEAERRTSEQITHRLSKLSERRPSVQIDSGSSVPSDQSPSVQIDSGSSVPSDQRPSVQIDRRMSGKVRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSISSKLNYTSSQEKTQAIVTKSDEFSEIDQGKGYHIRNQTYRRFPSIVYEDPYQVSLQYMEKHHILQIFQQITENLVYEKPEDPLNFMLCQV

SEQ ID NO: 10507 - protein, 353 aa, Homo sapiens
MPSPVGLLRALPLPWPQFLACTLRRLAGPRESTGPSQKPPPLCSVPCRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSLVKECHKCHGRGRYKCSGCHGAGTVRCPSCCGAKRKAKQSRRCQLCAGSGRRRCSTCSGRGNKTCATCKGEKKLLHFIQLVIMWKNSLFEFVSEHRLNCPRELLAKAKGENLFKDENSVVYPIVDFPLRDISLASQRGIAEHSAALASRARVLQQRQTIELIPLTEVHYWYQGKTYVYYIYGTDHQVYAVDYPERYCCGCTIV

SEQ ID NO: 10508 - protein, 353 aa, Homo sapiens; identical to SEQ ID NO: 10507

SEQ ID NO: 10509 - protein, 315 aa, Homo sapiens
MPSPVGLLRALPLPWPQFLACTLRRLAGPRESTGPSQKPPPLCSVPCRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSLVKECHKCHGRGRYKCSGCHGAGTVRCPSCCGAKRKAKQSRRCQLCAGSGRRRCSTCSGRGNKTCATCKGEKKLLHFIQLVIMWKNSLFEFVSEHRLNCPRELLAKAKGENLFKDENSVVYPIVDFPLRDISLASQRGIAEHSAALASRARVLQQVSQGGGAIWL

SEQ ID NO: 10510 - protein, 375 aa, Homo sapiens
MDRDLNEDDSVVDLSFEAESPLAPPTELLERLPSYDWLLQGGRGQIFFPPLEAPGRPQEQRSWPSFLEHRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSLVKECHKCHGRGRYKCSGCHGAGTVRCPSCCGAKRKAKQSRRCQLCAGSGRRRCSTCSGRGNKTCATCKGEKKLLHFIQLVIMWKNSLFEFVSEHRLNCPRELLAKAKGENLFKDENSVVYPIVDFPLRDISLASQRGIAEHSAALASRARVLQQRQTIELIPLTEVHYWYQGKTYVYYIYGTDHQVYAVDYPERYCCGCTIV

SEQ ID NO: 10511 - protein, 165 aa, Homo sapiens
MQAETILEGLEAGLPQAVSSGLSLVPAPGLVLTCLSAPSGPGGMALEPPPTTLRKAFLAQSTLLESTLEGAPEWAAPHPEEQRRSPPACSQHTPPLPSTPTGPPPCSPGGNHPLCALSGRGGGRCSIPSLSSSSTFSLFSSGCWNPRVKLRVRKSQSQGRAGQLI

SEQ ID NO: 10512 - protein, 354 aa, Homo sapiens
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 10513 - protein, 354 aa, Homo sapiens; identical to SEQ ID NO: 10512

SEQ ID NO: 10514 - protein, 354 aa, Homo sapiens; identical to SEQ ID NO: 10512

SEQ ID NO: 10515 - protein, 329 aa, Homo sapiens
MEMSGLSFSEMEGCRNLLGLLDNDEIMALCDTVTNRLVQPQDRQDAVHAILAYSQSAEELLRRRKVHREVIFKYLATQGIVIPPATEKHNLIQHAKDYWQKQPQLKLKETPEPVTKTEDIHLFQQQVKEDKKAEKVDFRRLGEEFCHWFFGLLNSQNPFLGPPQDEWGPQHFWHDVKLRFYYNTSEQNVMDYHGAEIVSLRLLSLVKEEFLFLSPNLDSHGLKCASSPHGLVMVGVAGTVHRGNTCLGIFEQIFGLIRCPFVENTWKIKFINLKIMGESSLAPGTLPKPSVKFEQSDLEAFYNVITVCGTNEVRHNVKQASDSGTGDQV

SEQ ID NO: 10516 - protein, 292 aa, Homo sapiens
MAQPQLYLPEPFKIAYRKVGQCRRFQQLKKKNGSFKRKGIERWHRAVSTNLLKQNVLVPKEESSSDSDMGFHESQQNQKSNLKTKVKTAFGRMLSYKYRSKPACASQEGSTDHKEALLSNTQSLLPRIVKEFSSPKLFTAKMRKLSENATIQLDVVEAETEEITQGNTLLRARRTTKRLSVTSLPSGLQKGPYSPKKRPHFPALKKKKRGMENILRKSDLTVGKLQMQVDDLIETVTDKSMKLLAQRHAELQQCEFLGDEILQSSKQFQRISKRTMRKYKLKNMTTKGPGDS

SEQ ID NO: 10517 - protein, 118 aa, Homo sapiens
MKVVGNYRVNTANSSTDTSGEHLTCLRSQLFVAYRNGRVDEAVSLGFLDCWIGGDLTNFKGCYLTNQLPIQIFTAIFDMNTDVIILSQFMYYRLKNQKKKISEEDLRKELHFCCLHWP

SEQ ID NO: 10518 - protein, 133 aa, Homo sapiens
MKVVGNYRVNTANSSTDTSGEHLTCLRSQLFVAYRNGRVDEAVSLGFLDCWIGGDLTNFKGCYLTNQLPIQDIPTSVIQRLHHQRESQIVTLGSPLPCIYPIFFQISEISMPGYYSCLCHTTINTSKRRFILT

SEQ ID NO: 10519 - protein, 135 aa, Homo sapiens
MKVVGNYRVNTANSSTDTSGEHLTCLRSQLFVAYRNGRVDEAVSLGFLDCWIGGDLTNFKGCYLTNQLPIQIFTAIFDMNTDVIILSQFMYYRLKNQKKKMIFQPQLFKDSITREKVRLSLWGVLCPVYIPYSFR

SEQ ID NO: 10520 - protein, 242 aa, Homo sapiens
MGTGASEKQAEQKVRRAFEASEEAHGTLAASTPWVAMGSAYGSCTCLGAQPVTDLALWPVIYSCMGFSPQAYPAFWAYPWVLYGGYLWMGYPPPAALVPSVWLYWRGASSFDPLIGSPYLAALAPNLFPFPMKFPPTYSLASPTLGGATSSHCPQVGCWTPASSAPRAAVEGPSRGAPYLKTCKAPPSEWASRFGIWAPLPCCSSELRPLPPSPIEDSQLDPGCSRSSSRSPCRARRRLFEC

SEQ ID NO: 10521 - protein, 267 aa, Homo sapiens
MHYIKTWSLLGEMSEKLRRCRKELTAAIDRAFEGVSYSQECTGQQRLELSAAPLSFSLPVHRLLCRRHPLAACSSAAPFAAVPCAPENENPAFATNHAPVNAKPHALCPERKPLTSKENVLMHSSILAPERESWRTAGEGENWRKENLRKDMERDLKADSNMPLNNSSQEVTKDLLDMIDHTSIRTIEELAGKIEFENELNHMCGHCQDSPFKEEAWALLMDKSPQKATDADPGSLKQAFDDHNIVETVLDLEEDYNVMTSFKYQIE

SEQ ID NO: 10522 - protein, 143 aa, Homo sapiens
MATPLDNCLRPFPDPMVKVTAETKKISEVSSYVSANNKKNSFWGSGLLYPVALLRCQDCWAGHQTHVLSKEFTSYFSSGAGREAQHQPSAVLGSLIWLRRVYLLRAMVVHGGSQPCQRWLVIRMEVGGHPSFPGHAWLTFHLN

SEQ ID NO: 10523 - protein, 563 aa, Homo sapiens
MIKRKIWCNLCIDLVAFTSEIFKGAVFQSLDGIVVSANCKLRKIFTLKSKPQDTADKDAVYGVPFSTDEPTDIIPRSCQLMTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHAANLHIMHPHPPQEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGEEDLSVEEDEEVLTLLYDPCLNCYFDPQTGKYYELV

SEQ ID NO: 10524 - protein, 238 aa, Homo sapiens
MSGFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEGNHSIQGSRGPTTGPSELTQLTLESLLGKAAKRTSKEYLRSAYTEAGATESQDSSMEQIDRNNFEMSLLPTTCLSPTGRRCGSCQKTPEPVIKAKDLSAQQVPASLNKTSLKEISGERLSSIPEASE

SEQ ID NO: 10525 - protein, 689 aa, Homo sapiens
MIKRKIWCNLCIDLVAFTSEIFKGAVFQSLDGIVVSANCKLRKIFTLKSKPQDTADKDAVYGVPFSTDEPTDIIPRSCQLMTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHAANLHIMHPHPPQEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEGNHSIQGSRGPTTGPSELTQLTLESLLGKAAKRTSKEYLRSAYTEAGATESQDSSMEQIDRNNFEMSLLPTTCLSPTGRRCGSCQKTPEPVIKAKDLSAQQVPASLNKTSLKEISGERLSSIPEASEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGEEDLSVEEDEEVLTLLYDPCLNCYFDPQTGKYYELV

SEQ ID NO: 10526 - protein, 250 aa, Homo sapiens
MSAAASPASERGWKSEKLDEAQALARSCAARRPDFQPCDGLSICATHSHGKCFKLHWCCHLGWCHCKYMYQPMTPVEQLPSTEIPARPREPTNTIQISVSLTEHFLKFASVFQPPLPPDSPRYCMISDLFIDNYQVKCINGKMCYVQKQPAPHSHRMSPEEVSAHDALISKESNTPKIDHCSSPSSSEDSGINAIGAHYVESCDEDTEEGAELSSEEDYSPESSWEPDECTLLSPSQSDLEVIETIETTV

SEQ ID NO: 10527 - protein, 175 aa, Homo sapiens
MTRTPVGSARTRPKPRKLGPQRGKALQASSRLSESPALVKKRMPDACTLGRAGIGLPKMCLHMAVRHSKAQKTGPGILQQRQKPPAPRASGGPALLGKRRGCSEAGSASLEPLSSSRAAAGCLNQVPLSPFLAGPRNTRRLPAPERERIELAATLCLEGWPLRCLASKGKLHCVY

SEQ ID NO: 10528 - protein, 163 aa, Homo sapiens
MQSVDSMLGTVGGCGGGEAASTFSKDPSGCCVGNDCRDGGRGLERRHGRWSRGEGGESGLCSGGQMASEIEYWDGLAISVMEVEKAFGSTNVLWKTEPFSLWACTAACPPSLSPTLLALGLPRDGKELAEQGSLWTVLEPGGDWSHSQSQLGTPGRGKGALGF

SEQ ID NO: 10529 - protein, 266 aa, Homo sapiens
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 10530 - protein, 242 aa, Homo sapiens
MFVELNNLLNTTPDRAEQGKLTLLCDAKTDGSFLVHHFLSFYLKGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 10531 - protein, 100 aa, Homo sapiens
MHVCDLQKLVRIQLAFTTFPWMFSCHLLPTPELSSKRNQCLLYKTSGCLTQMPILYGHPATLLKDYILQAILQPGKKIQGGTEIQRGSFANQYQTDASHL

SEQ ID NO: 10532 - protein, 247 aa, Homo sapiens
MWGPGVTAEGLSVAPAPPPLLPLLLLLALALVAPSRGGGGCAELACGERERCCDATNATAVRCCKLPLHAFLDNVGWFVRKLSGLLILLVLFAIGYFLQRIICPSPRRYPRGQARPGQRPGPPGGAGPLGGAGPPDDDDDSPALLRDEAAAGSQDSLLDSGGGGRGRGGGGRSDPSCASEHEMRVVSPVFLQLPSYEEVKYLPTYEESMRLQQLSPGEVVLPVSVLGRPRGGVAAEPDGGEGRYPLI

SEQ ID NO: 10533 - protein, 359 aa, Homo sapiens
MNLNPPTSALQIEGKGSHIMARNVSCFLVRHTPHPRRVCHIKGLNNIPICTVNDDENAFGTLWGVGQSNYLEKNRIPFANCSYPSSTAVQESPVRGMSPAPNGAKVPPRPHSEPSRKIKECFKTSSENPLVIKKEEIKAKRPPSPPKACSTPGSCSSGMTSTKNDVKANTICIPNYLDQEIKILAKLCSILHTDSLAEVLQWLLHATSKEKEWVSALIHSELAEINLLTHHRRNTSMEPAAETGKPPTVKSPPTVKLPPNFTAKSKVLTRDTEGDQPTRVSSQGSEENKEVPKEAEHKPPLLIRRNNMKIPVAEYFSKPNSPPRPNTQESGSAKPVSARSIQEYNLCPQRACYPSTHRR

SEQ ID NO: 10534 - protein, 314 aa, Homo sapiens
MGCRCCKIIQSYLFDPVQVPSPGYVNEVNSCKLDEDDTDKLKGKWSSEVLVQKNDPQRQGSKKTESSSRTADPWEPCWPHQGPLPQGDAGGEHHACGVNGIGPAATPQPTGNSSPTQDDRGSWASTANTVPPTQPFLEGGGTRKQDCVLLASEGTQVMRNGDSRAPSEAESFALEVQDHVFQIPAPDYLQHWGPAGDNVDHNEKDCVFKNHTEDESLEGIQPPVGEHGLNTPFSVRRSWDSLNEDVETEVLSICFNEKGPVHAMPVVDSGNRQEDTHGSDGDGDGEIVDEDAAVAEALAALEAATAGEDLDETD

SEQ ID NO: 10535 - protein, 314 aa, Homo sapiens; identical to SEQ ID NO: 10534

SEQ ID NO: 10536 - protein, 233 aa, Homo sapiens
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSSVIFIRDRNSHGQEISGYIDYAHRLKTEDFEVYFTGKKRLLPRPTDISFYNWDADIAVSNSSPNYQVIADNPEGLLFRYKRDRKILNVDPKAQPGDNSTRITILTELYVQAVIFDHISRRKT

SEQ ID NO: 10537 - protein, 250 aa, Homo sapiens
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSLNQQETDAAHILKKQLASVIFIRDRNSHGQEISGYIDYAHRLKTEDFEVYFTGKKRLLPRPTDISFYNWDADIAVSNSSPNYQVIADNPEGLLFRYKRDRKILNVDPKAQPGDNSTRITILTELYVQAVIFDHISRRKT

SEQ ID NO: 10538 - protein, 199 aa, Homo sapiens
MDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRMSRGETKWEGKAYLPWSYFPPNVTKFNSFAIHGSKDKRSYEALYPVPQHELQQGQKPDFHCLEYFKSFNFNTLLGEEWKQPESDLWLIEKCDI

SEQ ID NO: 10539 - protein, 199 aa, Homo sapiens; identical to SEQ ID NO: 10538

SEQ ID NO: 10540 - protein, 64 aa, Homo sapiens
MDFKIEHTWDGFPVKHEPVFIRLNPGDRGVMMDISAPFFRDPPAPLGEPGKPFNELWDYEVVEA

SEQ ID NO: 10541 - protein, 117 aa, Homo sapiens
MAYGVPRKNTVKTILRGSCYNVQEPWDIALLAKTWSTNLANIKLPFLEEISFGGSVQLTKCTTIKDGLLPSAESIKLEREYEVKRLCKLKCQENTSKEIQLLLRERPAGLRRPLPSK

SEQ ID NO: 10542 - protein, 117 aa, Homo sapiens; identical to SEQ ID NO: 10541

SEQ ID NO: 10543 - protein, 81 aa, Homo sapiens
MAYGVPRKNTVKTILRGSCYNVQEPWDIALLAKTWSTNLANIKLPFLEEISFGGSVQLTKCTTIKDGLLPSAESIKLEREY

SEQ ID NO: 10544 - protein, 113 aa, Homo sapiens
MAYGVPRKNTVKTILRGSCYNVQEPWDIALLAKTWSTNLANIKLPFLEEISFGGSVQLTKCTTIKDGLLPSAESIKLEREYEVKRLCKLKCQENTSKEIQLLLRERPAGLRRP

SEQ ID NO: 10545 - protein, 459 aa, Homo sapiens
MYDRAPRLLKLAEGGSTEAHVGPGSYQVPFLKQQATGSNAPFLSLTARESTFTIASSIEKAVPGPGHYNVSEAQKISRSPTLTRSVDVPSIPSCGKSYGYHINDDGSIIKCFPPACDSTLGPAYYKPQFDVSNATLKYKGIHFGNSSGRQELPKKSGPGPGQYDIVQKKTSYYENVNIKRDQQQNYCSFIPRLYEIIVLQEKKKRFLPMKSITPAPGTYNEPRTALKSLKKTSGLKNIPFGQSAVRFTQDIRTEEMPGPGFYNVLNNTIIASVRNICSKKQKKSAFGSSVPRTFFSVQKEACATPGPADYQEFWHSQGVGISDELPNLTNKYAAFLSRAKRTMKVPDMVIPAPGSYDVHKSYEMSQVKHKYMPPRSLVAKRKHASFLSATPRCLEKVTDGPGPAAYNPVLRKSCPIPLFVKASKRFEESKEITPGPATYEISQEKKKGNLIGEMAADIM

SEQ ID NO: 10546 - protein, 200 aa, Homo sapiens
MTSAETASRAAESGGTPVRPCSRPHRAPSPAAPSRPGAPAAGPRKLLVPGLPCLVRGGWPWTRPDSSPFRPAARPRMSPHRSPAVARRCGRPRRRDPRRRRTPALPRPWPGRGGPGRSLLHRHLFIQQLLRTCWPALPRDRTPAPGGTMPGAALAGPGRQASGSPAPQSEGAPPRPWTPLQPGLHHRPPSSSSGLLSSFF

SEQ ID NO: 10547 - protein, 157 aa, Homo sapiens
MEGCAVRRGSCPLLPGPSAWRASPAGWAGRAKLRSWCRASGLPNRPYTLTGGRHGSVSLLRHPGTTTFVQQRSLHQSWEKRIVFSACPVSRSWCPERNFSGSIPAVTPPKLPGHSKSEGPPGKVRKRTTIRSQPLFVTRTRGFGSAVGWLPLGSPVL

SEQ ID NO: 10548 - protein, 186 aa, Homo sapiens
MWLVECTGRDLTGLSCLLSMDRQPRRRQHVAGCRDVPPPLPQGSWGQTSPRHSILCSKSGCDLLGGGEYNGETSGEEFLAPAWTCRAQQAATWLSVQQTSHKALGPAGGAAMSSKLSPEEQFLSRIHFLRTFMCSVAGAELPGIPQATENGEGCRPARDPASSPSSLSMASVYTQCSSAQLVSALS

SEQ ID NO: 10549 - protein, 203 aa, Homo sapiens
MPKAPKGKSAGREKKVIHPYSRKAAQITREAHKQEKKEKLKNEKALRLNLVGEKLQWFQNHLDPQKKRYSKKDACELIERYLNRFSSELEQIELHNSIRDRQGRRHCSRETVIKQTMERERQQFEGYGLEIPDILNASNLKTFREWDFDLKKLPNIKMRKICANDAIPKTCKRKTIITVDQDLGELELNDESSDSDEEMTAVA

SEQ ID NO: 10550 - protein, 278 aa, Homo sapiens
MVRGAGPGPSLSALSHPTGASGMAAAEGPGYLVSPQAEKHRRARNWTDAEMRGLMLVWEEFFDELKQTKRNAKVYEKMASKLFEMTGERRLGEEIKIKITNMTFQYRKLKCMTDSESAPPDWPYYLAIDGILAKVPESCDGKLPDSQPPGPSTSQTEASLSPPAKSTPLYFPYNQCSYEGRFEDDRSDSSSSLLSLKFRSEERPVKKRKVQSCHLQKKQLRLLEAMVEEQRRLSRAVEETCREVRRVLDQQHILQVQSLQLQERMMSLLERIITKSSV

SEQ ID NO: 10551 - protein, 186 aa, Homo sapiens
MASVSYQKPTSTTVGKQMIFTGPDYIKDYLPKIHQHTSYVGEQHLALEKTGDLRYLWRPASNRSLPAKYKHEYVSEIGWRIPQYNFINKSRLGSGFHIKYEELSQASLDSITHRYQNPWQPKPHVLDMQGKQSRASFAWHMSAFEDTDQRNSKWAILVRQCKSSLPRASKPPKLPKLPKKEKKRKH

SEQ ID NO: 10552 - protein, 113 aa, Homo sapiens
MADPEELQVSSPPPPPPSSPSSSDASAASSPGGPVSLGWPVPSRSSGPTVDQLEEVELQIGDAAFSLTKLLEATSAVSAQVEELAFKCTENARFLKTWRDLLKEGYDSLKPDD

SEQ ID NO: 10553 - protein, 309 aa, Homo sapiens
MPAEGGKTDMERIGLFSEMEYITVGDKYVSQFNRPFNEAASKNKQMLPGGSKEMSDLQAGYFDPHFVRIFEGEGYINLNQVRRRDMVEAAKKNLGKAFLPSNGEKKPCGLGSYYGTIGGPVPFFSAQSKPREKYKAPGKNLYTNPGKKGTGYGYANITIGKQFSHSADFYDAAKLKYKKANEEHHRLLKGAPFKLNLHPRDYFDANPYFSEESLPPIKKEEKKKTISNTFKPSSPGKKPGGMKAGTFDPYPSHSADPYVAKLANISGKDDKIFHPPSGPKSRPVESIMTLNVRRALNSKNYKTSSVPSY

SEQ ID NO: 10554 - protein, 161 aa, Homo sapiens
MPAEGGKTDMERIGLFSEMEYITVGDKYVSQFNRPFNEAASKNKQMLPGGSKEMSDLQAGYFDPHFVRIFEGEGYINLNQVRRRDMVEAAKKNLGKAFLPSNGEKKPCGLGSYYGTIGGPVPFFSAQSKPREKYKAPGKNLYTNPGKKGTGYGYANITIGK

SEQ ID NO: 10555 - protein, 178 aa, Homo sapiens
MPAEGGKTDMERIGLFSEMEYITVGDKYVSQFNRPFNEAASKNKQMLPGGSKEMSDLQAGYFDPHFVRIFEGEGYINLNQVRRRDMVEAAKKNLGKAFLPSNGEKKPCGLGSYYGTIGGPVPFFSAQSKPREKYKAPGKNLYTNPGKKGTGYGYANITIGKQFSHSADFYDAAKLKYK

SEQ ID NO: 10556 - protein, 276 aa, Homo sapiens
MLRDSEAEVTEEDPRLRAQQLHHRVLTLQCQLRDQGAAHQASLDEATRLQEELQAKLEELQKKQHEAKLAVTPLKAKIASLVRKCRERNRLITHLLQELHRHGLGNLLLSELAQNMLNDVALAEYTATFLAPGVPETSHHLDVKSEMTAALRAQTYLLNPEMDSVLQSSLSSESWPIPEPEWPAQTAQLDSLKLPLSLVSTLDPGTCLAAVTVEPGLPAQRLQEKGGMPCPALQVDNVPAPSELLSPARILAFHQELRQSICSNSQVHKSPLELEM

SEQ ID NO: 10557 - protein, 750 aa, Homo sapiens
MLFFAGETGLPLFPRFALSVEGAEPTDHGHPQAVSKGHNRCALTIDELAQDVEACFQQLSTLQPGSRGWQCSASACRGENWSFAQKWHSGWERAHSQQVWGNWGICSNEEAKSKESGEGDKPGKTTALGTSEVPGNPGTLPHWDEASPNPPQGPAEPWGALERVRSRFHQLISGLKKQRSQILHDNTKLHGDQERFHERVCALEREREREVTKISRLERDNHRLVGDISQLKKELDQYLQAISDLEDCNGKSYCKILELEEENETLKGNLGQLQKATSESVRKSKDTMEQVTLENWKLQTLISELGVSYKELIKDIVLGIEDMIRALSGENEHLLRRVHVLEREVTLQRSTDQGRLVRGREHLQGKAKMHALDKEVQVTPLTGQLLSRACGPPLEEEMSLAAGQTGPSTGTGNSRRGADSPPPSLVWRNTGVANALQGNVSGAEVKEAHLEKEEKRPRCSVAQGQALSSLSNGPMLRDSEAEVTEEDPRLRAQQLHHRVLTLQCQLRDQGAAHQASLDEATRLQEELQAKLEELQKKQHEAKLAVTPLKAKIASLVRKCRERNRLITHLLQELHRHGLGNLLLSELAQNMLNDVALAEYTATFLAPGVPETSHHLDVKSEMTAALRAQTYLLNPEMDSVLQSSLSSESWPIPEPEWPAQTAQLDSLKLPLSLVSTLDPGTCLAAVTVEPGLPAQRLQEKGGMPCPALQVDNVPAPSELLSPARILAFHQELRQSICSNSQVHKSPLELEM

SEQ ID NO: 10558 - protein, 202 aa, Homo sapiens
MSHYFYLTPQILLPFSPLTSQEFDLIRRKAGASWQDETRWSDSSVTTYTGSYRKKQLDKSMCSQFSFRAGQHEPECKQMSLTNSSACHLLCWAGTQETTDIKGLFPDITRPFKKSFDVKHGVAHQIWDFGDCFPTPPNYGKYCVRPKKPAQEALINYSRRGKGVLKHLHGRCDSESKVCSSEDSEADRYSDYGWGGPSSPFN

SEQ ID NO: 10559 - protein, 162 aa, Homo sapiens
  MOD_RES (1)..(1): Any amino acid
XDSSVTTYTGSYRKKQLDKSMCSQFSFRAGQHEPECKQMSLTNSSACHLLCWAGTQETTDIKGLFPDITRPFKKSFDVKHGVAHQIWDFGDCFPTPPNYGKYCVRPKKPAQEALINYSRRGKGVLKHLHGRCDSESKVCSSEDSEADRYSDYGWGGPSSPFN

SEQ ID NO: 10560 - protein, 168 aa, Homo sapiens
MVKEVWRVLREEPGRRKESRQNRARGNRVQQNSSNLNPTPAPGPHSTESRGRRRAGSEAPPVPGSESLSTSSERGHGPAVGNLVSESAGRSAGQGSPGPDAMSRNLRTALIFGGFISLIGAAFYPIYFRPLMRLEEYKKEQAINRAGIVQEDVQPPGLKVWSDPFGRK

SEQ ID NO: 10561 - protein, 67 aa, Homo sapiens
MSRNLRTALIFGGFISLIGAAFYPIYFRPLMRLEEYKKEQAINRAGIVQEDVQPPGLKVWSDPFGRK

SEQ ID NO: 10562 - protein, 93 aa, Homo sapiens
MDTQKQIHKTHNSKNQFFTIFFFLSVEFGKEGTRKNFYLLLSIGHYGRKSRRADLGTADTADKTEPECFAASWTFDPNPSVTVSGAHSTAVHQ

SEQ ID NO: 10563 - protein, 158 aa, Homo sapiens
MPEPPTPSVGSCAARASRMSAAPCSRAPSPIDHPRAEECGRAARDWQAAPPAAPVRDPLGEASWAPESGEDMENLYVQLKLQSVGTCFNREELPSVLQGEELGATSVTNKPGLSAMRKETDQQVGERKLTYCGDQVTLFTDQALSQILSSEEGRIKVM

SEQ ID NO: 10564 - protein, 442 aa, Homo sapiens
MSDSAGGRAGLRRYPKLPVWVVEDHQEVLPFIYRAIGSKHLPASNVSFLHFDSHPDLLIPVNMPADTVFDKETLFGELSIENWIMPAVYAGHFSHVIWFHPTWAQQIREGRHHFLVGKDTSTTTIRVTSTDHYFLSDGLYVPEDQLENQKPLQLDVIMVKPYKLCNNQEENDAVSSAKKPKLALEDSENTASTNCDSSSEGLEKDTATQRSDQTCLEPSCSCSSENQECQTAASTGEILEILKKGKAFVLDIDLDFFSVKNPFKEMFTQEEYKILQELYQFKKPGTNLTEEDLVDIVDTRIHQLEDLEATFADLCDGDDEETVQRWASNPGMESLVPLVQSLKKRMEVPDYEMVHQAGLTCDYSELPHHISTEQEIECLIQSVHYLLKNLPNPTLVTIARSSLDDYCPSDQVDTIQEKVLNMLRALYGNLDLQVYAAESPPS

SEQ ID NO: 10565 - protein, 163 aa, Homo sapiens
MEVPDYEMFPASSSSPSETTSAWISLSMSLSAFWSKPFNKSLGSSKLSNISLPSSEPSKLFQPLPVPKLLPHFQVHQAGLTCDYSELPHHISTEQEIECLIQSVHYLLKNLPNPTLVTIARSSLDDYCPSDQVDTIQEKVLNMLRALYGNLDLQVYAAESPPS

SEQ ID NO: 10566 - protein, 177 aa, Homo sapiens
LVSQEEYKILQELYQFKKPGTNLTEEDLVDIVDTRIHQLEDLEATFADLCDGDDEETVQRWASNPGMESLVPLVQSLKKRMEVPDYEMVHQAGLTCDYSELPHHISTEQEIECLIQSVHYLLKNLPNPTLVTIARSSLDDYCPSDQVDTIQEKVLNMLRALYGNLDLQVYAAESPPS

SEQ ID NO: 10567 - protein, 188 aa, Homo sapiens
MMHPVASSNPAFCGPGKPSCLNEDAMRAADQFDIYSSQQSKYSHTVNHKPMVCQRQDPLNETHLQTTSGRSIEIKDELKKKKNLNRSGKRGRPSGTTKSAGYRTSTGRPLGTTKAAGFKTSPGRPLGTTKAAGYKVSPGRPPGSIKALSRLADLGYGCGTAAFPYPMMHGRAVHGVEETSSEVKPPNE

SEQ ID NO: 10568 - protein, 188 aa, Homo sapiens; identical to SEQ ID NO: 10567

SEQ ID NO: 10569 - protein, 188 aa, Homo sapiens; identical to SEQ ID NO: 10567

SEQ ID NO: 10570 - protein, 7 aa, Homo sapiens
MMHPVAS

SEQ ID NO: 10571 - protein, 333 aa, Homo sapiens
MPRSFEQVIILKKWFLKPYKGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKDLIIKRIKPKPQQGDDITVVDVEKQIEAFRSRLIQMLGEPLVPQLQDKVHLLKLLLFYAADLNPDAEPFQKGWSGS

SEQ ID NO: 10572 - protein, 457 aa, Homo sapiens
MEDFIVISDDSGSESSGGARPGRSRRPRRALSRTSGALPRRTVNKGQKLEPIPHRRLRMVTNTIEENFPLGTVQFLMDFVSPQHYPPREIVAHIIQKILLSGSETVDVLKEAYMLLMKIQQLHPANAKTVEWDWKLLTYVMEEEGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKDLIIKRIKPKPQQGDDITVVDVEKQIEAFRSRLIQMLGEPLVPQLQDKVHLLKLLLFYAADLNPDAEPFQKGWSGS

SEQ ID NO: 10573 - protein, 325 aa, Homo sapiens
MEGHVDRSSQPTARRIINSDPVDLDLVEENTFVGPPPATSISGGSVYPTEPNCSSATFTGNLSFLASLQLSSDVSSLSPTSNNSRSSSSSSNQKAPLPCPQQDVSRPPQALPCPLRPLPCPPRASPCPPRASSCPPRALSCPSQTMQCQLPALTHPPQEVPCPRQNIPGPPQDSLGLPQDVPGLPQSILHPQDVAYLQDMPRSPGDVPQSPSDVSPSPDAPQSPGGMPHLPGDVLHSPGDMPHSSGDVTHSPRDIPHLPGDRPDFTQNDVQNRDMPMDISALSSPSCSPTWGTEQDSVKKKKKKKRKEIPPNFLLFNLYRTRVKN

SEQ ID NO: 10574 - protein, 611 aa, Homo sapiens [sequence omitted]

SEQ ID NO: 10575 - protein, 457 aa, Homo sapiens; identical to SEQ ID NO: 10572

SEQ ID NO: 10576 - protein, 872 aa, Homo sapiens
MAPASASGEDLRKLPTMAEVNGEQDFIDLTRETRPRTKDRSGLYVIDLTRAEGENRPIATLDLTLEPVTPSQKEPTSLQTCASLSGKAVMEGHVDRSSQPTARRIINSDPVDLDLVEENTFVGPPPATSISGGSVYPTEPNCSSATFTGNLSFLASLQLSSDVSSLSPTSNNSRSSSSSSNQKAPLPCPQQDVSRPPQALPCPLRPLPCPPRASPCPPRASSCPPRALSCPSQTMQCQLPALTHPPQEVPCPRQNIPGPPQDSLGLPQDVPGLPQSILHPQDVAYLQDMPRSPGDVPQSPSDVSPSPDAPQSPGGMPHLPGDVLHSPGDMPHSSGDVTHSPRDIPHLPGDRPDFTQNDVQNRDMPMDISALSSPSCSPSPQSETPLEKVPWLSVMETPARKEISLSEPAKPGSAHVQSRTPQGGLYNRPCLHRLKYFLRPPVHHLFFQTLIPDKDTRENKGQKLEPIPHRRLRMVTNTIEENFPLGTVQFLMDFVSPQHYPPREIVAHIIQKILLSGSETVDVLKEAYMLLMKIQQLHPANAKTVEWDWKLLTYVMEEEGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVEHLQFLLSSYQHVLREHLRSSVIDRKDLIIKRIKPKPQQGDDITVVDVEKQIEAFRSRLIQMLGEPLVPQLQDKVHLLKLLLFYAADLNPDAEPFQKGWSGS

SEQ ID NO: 10577 - protein, 96 aa, Homo sapiens
MTPCLESFCQRAKDCKQNIPLPFLIQDWPLSESKPQGQDFWTPQPLQAAAPSHEFQQVALHPARTRLASRPQGGRLMSSREVGLRAPRCSCGKRKR

SEQ ID NO: 10578 - protein, 96 aa, Homo sapiens; identical to SEQ ID NO: 10577

SEQ ID NO: 10579 - protein, 206 aa, Homo sapiens
MEVDINGESRSTLTTLPFPGAEANSPGKAEAEKPRCSSTPCSPMRRTVSGYQILHMDSNYLVGFTTGEELLKLAQKCTGGEESKAEAMPSLRSKQLDAGLARSSRLYKTRSRYYQPYEIPAVNGRRRRRMPSSGDKCTKSLPYEPYKALHGPLPLCLLKGKRAHSKSLDYLNLDKMIKEPADTEVLQYQLQHLTLRGDRVFARNNT

SEQ ID NO: 10580 - protein, 206 aa, Homo sapiens; identical to SEQ ID NO: 10579

SEQ ID NO: 10581 - protein, 206 aa, Homo sapiens; identical to SEQ ID NO: 10579

SEQ ID NO: 10582 - protein, 206 aa, Homo sapiens; identical to SEQ ID NO: 10579

SEQ ID NO: 10583 - protein, 97 aa, Homo sapiens
MNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 10584 - protein, 638 aa, Homo sapiens
MAAELRMILYEDDSVQVQYVDGSTLQLSPCGTEFLFEKSPPVSAHPLEQPERIRQRTHFVISTYREQLQRALDFRNSSATCPFLSETIIPSERKKHIFIDITEVRWPSLDTDGTMIYMESGIVKITSLDGHAYLCLPRSQHEFTVHFLCKVSQKSDSSAVLSETNNKAPKDKLVEKTGKICIRGNLPGQRLKNKENEFHCQIMKSKETLKKMSCVNGTEGREELPSPGTKHTCVYTWVKQCWSVAACPEEWKYPLSLALHFHNKISNMSKIDAHITQSRFLTSDISEERGKVVSVLPRALSLSCPVPHLHRWNFCDSLLQRQSDEYSYPELVKMVWYKGVTYRLTHQNMNSIEIYSGDGSVFKSEGAYFGNYFTYYSIQEGSGKREEKTYSVNNLPPDRPGSPFTVGSLIKQATRILQHCVKMRLSLSHNYRICCWKMVPGINDSNILPLVLKESLIPSVGRFLAYSDDKVHAIFLDGITLTLNWNFSSPIEKRQVNQGLNLGWCKLTFPDGQEQLIQIEHPEPYERYVTTVTSWCRRLTQTSPREMPTHSSSSVLQENWSVASELEKIQKFNLLLENSGILNQISNKKNEQQSFDHYKPGSSETLLGEVNENRVSIALKKTSEILHDIDCLLSNSKK

SEQ ID NO: 10585 - protein, 299 aa, Homo sapiens
MPGRLLRGLWQRWRRYKYRFVPWIALNLSHNPRTLRYVPEESKDKVISDEDVLGTLLKVFQALFLNDFNKQSEILSMLPESVKSKYQDLLAVEHQGVKLLENRHQQQSTFKPEEILYKTLGFSVAQATSSLISAGKGVFVTKGLVPKGAVVSMYPGTVYQKYEPIFFQSIGNPFIFRCLDGVLIDGNDKGISKVVYRSCNGRDRLGPLKMSDSTWLTSEIHNPLAVGQYVNNCSNDRAANVCYQEFDVPAVFPIELKQYLPNIAYSYDKQSPLRCVVLVALRDINQGEELFSNYYTIVS

SEQ ID NO: 10586 - protein, 271 aa, Homo sapiens
MPGRLLRGLWQRWRRYKYRFVPWIALNLSHNPRTLRYVPEESKDKVISDEDVLGTLLKVFQALFLNDFNKQSEILSMLPESVKSKYQDLLAVEHQGVKLLENRHQQQSTFKPEEILYKTLGFSVAQATSSLISAGKGVFVTKGLVPKGAVVSMYPGTVYQKYEPIFFQSIGNPFIFRCLDGVLIDGNDKGISKVVYRSCNGRDRLGPLKMSDSTWLTSEIHNPLAVGQYVNNCSNDRAANVCYQEFDVPAVFPIELKQYLPNIAYSYDKQR

SEQ ID NO: 10587 - protein, 193 aa, Homo sapiens
MEQHFLGCVKRAWDSAEVAPEPQPPPIVSSEDRGPWPLPLYPVLGEYSLDSCDLGLLSSPCWRLPGVYWQNGLSPGVQSTLEPSTAKPTEFSWPGTQKQQEAPVEEVGQAEEPDRLRLQQLPWSSPLHPWDRQQDTEVCDSGCLLERRHPPALQPWRHLPGFSDCLEWILRVGFAAFSVLWACCSRICGAKQP

SEQ ID NO: 10588 - protein, 639 aa, Homo sapiens
MPQPSVSGMDPPFGDAFRSHTFSEQTLMSTDLLANSSDPDFMYELDREMNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHTDAAKENTCYCGAVAKRQEKKGMEPLQGHATPALPFKETQELLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGYENDSVEDLKEVTSISSRKRGKRRYFWEYSEQLTPSQQERMLRPSEWNRDTLPSNMYQKNGLHHGKYAVKKSRRTDVEDLTPNPKKLLQIGNELRKLNKVISDLTPVSELPLTARPRSRKEKNKLASRACRLKKKAQYEANKVKLWGLNTEYDNLLFVINSIKQEIVNRVQNPRDERGPNMGQKLEILIKDTLGLPVAGQTSEFVNQVLEKTAEGNPTGGLVGLRIPTSKV

SEQ ID NO: 10589 - protein, 639 aa, Homo sapiens
IPKPSVSGMDPPFGDAFRSHTFSEQTLMSTDLLANSSDPDFMYELDREMNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHTDAAKENTCYCGAVAKRQEKKGMEPLQGHATPALPFKETQELLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGYENDSVEDLKEVTSISSRKRGKRRYFWEYSEQLTPSQQERMLRPSEWNRDTLPSNMYQKNGLHHGKYAVKKSRRTDVEDLTPNPKKLLQIGNELRKLNKVISDLTPVSELPLTARPRSRKEKNKLASRACRLKKKAQYEANKVKLWGLNTEYDNLLFVINSIKQEIVNRVQNPRDERGPNMGQKLEILIKDTLGLPVAGQTSEFVNQVLEKTAEGNPTGGLVGLRIPTSKV

SEQ ID NO: 10590 - protein, 417 aa, Homo sapiens
MPQPSVSGMDPPFGDAFRSHTFSEQTLMSTDLLANSSDPDFMYELDREMNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHTDAAKENTCYCGAVAKRQEKKGMEPLQGHATPALPFKETQELLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGIIMLASLPD

SEQ ID NO: 10591 - protein, 417 aa, Homo sapiens; identical to SEQ ID NO: 10590

SEQ ID NO: 10592 - protein, 26 aa, Homo sapiens
MPQPSVSGMDPPFGDAFRSHTFSEQT

SEQ ID NO: 10593 - protein, 653 aa, Homo sapiens
MPQPSVSGMDPPFGDAFRSHTFSEQTLMSTDLLANSSDPDFMYELDREMNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHTDAAKENTCYCGAVAKRQEKKGMEPLQGHATPALPFKETQELLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGYENDSVEDLKEVTSISSRKRGKRRYFWEYSEQLTPSQQERMLRPSEWNRDTLPSNMYQKNGLHHGKYAVKKSRRTDVEDLTPNPKKLLQIGNELRKLNKVISDLTPVSELPLTARPRSRKEKNKLASRACRLKKKAQYEANKVKLWGLNTEYDNLLFVINSIKQEIVNRVQNPRDERGPNMGQKLEILIKDTLGLPVAGQTSEFVNQVLEKTAEGNPTGGLVFWGNSKTGNILYDENPNEKKQDI

SEQ ID NO: 10594 - protein, 641 aa, Homo sapiens
MPQPSVSGMDPPFGDAFRSHTFSEQTLMSTDLLANSSDPDFMYELDREMNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHTDAAKENTCYCGAVAKRQEKKGMEPLQGHATPALPFKETQELLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGYENDSVEDLKEVTSISSRKRGKRRYFWEYSEQLTPSQQERMLRPSEWNRDTLPSNMYQKNGLHHGSGKYAVKKSRRTDVEDLTPNPKKLLQIGNELRKLNKVISDLTPVSELPLTARPRSRKEKNKLASRACRLKKKAQYEANKVKLWGLNTEYDNLLFVINSIKQEIVNRVQNPRDERGPNMGQKLEILIKDTLGLPVAGQTSEFVNQVLEKTAEGNPTGGLVGLRIPTSKV

SEQ ID NO: 10595 - protein, 2095 aa, Homo sapiens
MADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILKMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLVGHTYINVIDIEANDLLQELPVREEPSNDNVIKQQSDHLAVPSSAELHYMAASVTNAVPPHNFKSQGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 10596 - protein, 1813 aa, Homo sapiens
MADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILKMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLVGHTYINVIDIEANDLLQELPVREEPSNDNVIKQQSDHLAVPSSAELHYMAASVTNAVPPHNFKSQEVTPACLDGKSLRAGITEVKEPSVTSPTPSDIQQNKGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRFS

SEQ ID NO: 10597 - protein, 3197 aa, Homo sapiens
MEIRLEILTSTGIKQKKPWPRVSWLGKEKEAVFLLDDKFINEINLLSGKIKKKIPSLQPFLKDVIVLTTSSNDAWLAGVLTTGELFLWNKDQDCLKTIPITEKPKEMIKATVASSLRLYLYVSGNGKRIVLITPSGCIFLWEYLELKNILSSKSLSLAGRWSQVIPEEAVLLPSTEDKEAVVNAVFIKNELFGDCCLCSFTFYSGECLKLTFLAIRWHENVFTSVRSLPYHVHWAQQDCHLCSLIPKCESVKSRGALISAFSRDGLTLAVTLNQKDPKATQVLFINTLNFVTLCGSLKGCSNKSPVVPATLIRSYWVGDISWTHDSLFLACMLKRGSLVLLTCQGELLTLITFGCSIEFGPAEFIPLHPLITYRPQQFTFQDSNNSVDSSASDSDPMRQRFSIKAHSRLPYLVISDGYMVTTLRFLDSLSPSVHMRSLLLDSTQRLEKIYQSVILSKPKGKGLNLRSLNSLRSSLLEHQGNESSADFTVPKFLQAEETINENAADFQDFEAEETNEGRHFPDNLCPFWNKRDDVLCSSMKEGRLEFASMFDTIHAKDDSEETDRTITELHSIQKSLLAAWTIGISKTVTEKNLMLNYIVVCITHFFYILQFIKCPFPKLDLVLSKSSRHNAWILCIFQLFHQCLSIHYWDIRYKQDVGHLIKLTSNTVKLLLTQQQKGQLFSEKLLACFYLLKMVADNLNGVYILQPEVISASADGSKITAQDSLVVPIFQMFQDSGFQKNWSWNSFFKIHPQVVNPVQQPGHRLLILWRILYKKTLWYQAQLNRRVPEADSQLTEKMTHEASTVKSLLCHLQANLQSTGDCLNQTLELKSINGEECFLLGSYEKSVQLWKKALQEIEEKGGRRTYFLQIRYYLSLLYCHLYSYNLNDAQGLCDQLAREILRWSQLPVKENKDFSGAAKSHFECGMVGGVHPEAAVRVVQSMARFMAAYFTNQQLCILPPHHVNVLPPLHIKTEQSFRLIPLQHSKVASVVRDQNLSNVWTVEYALELLFIGGLVPEAVWLAYKLGDWKTSVSIGVAFQLFCKRDSNFMRSKKKSLNLPLRMTPAQIFQEKLQCVLGQPASLEAKNEMGSKYKQFTDPIEEEDANLLFGSVQEVLKASVMADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILNRMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLELPVREEPSNDNVIKQQSDHLAVPSSAELHYMAASVTNAVPPHNFKSQGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 10598 - protein, 3197 aa, Homo sapiens; identical to SEQ ID NO: 10597

SEQ ID NO: 10599 - protein, 411 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAETDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 10600 - protein, 417 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAESDLSSVTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 10601 - protein, 412 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAETDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 10602 - protein, 419 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAEKQIANVTTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 10603 - protein, 418 aa, Homo sapiens
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAESDLSSVTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 10604 - protein, 343 aa, Homo sapiens
MASLQRSRVLRCCSCRLFQAHQVKKSVKWTCKACGEKQSFLQAYGEGSGADCRRHVQKLNLLQGQVSELPLRSLEETVSASEEENVGHQQAGNVKQQEKSQPSESRWLKYLEKDSQELELEGTGVCFSKQPSSKMEEPGPRFSQDLPRKRKWSRSTVQPPCSRGVQDSGGSEVAWGPQKGQAGLTWKVKQGSSPCLQENSADCSAGELRGPGKELWSPIQQVTATSSKWAQFVLPPRKSSHVDSEQPRSLQRDPRPAGPAQAKQGTPRAQASREGLSRPTAAVQLPRATHPVTSGSERPCGKTSWDARTPWAEGGPLVLEAQNPRPTRLCDLFITGEDFDDDV

SEQ ID NO: 10605 - protein, 288 aa, Homo sapiens
MASLQRSRVLRCCSCRLFQAHQVKKSVKWTCKACGEKQSFLQEKSQPSESRWLKYLEKDSQELELEGTGVCFSKQPSSKMEEPGPRFSQDLPRKRKWSRSTVQPPCSRGVQDSGGSEVAWGPQKGQAGLTWKVKQGSSPCLQENSADCSAGELRGPGKELWSPIQQVTATSSKWAQFVLPPRKSSHVDSEQPRSLQRDPRPAGPAQAKQGTPRAQASREGLSRPTAAVQLPRATHPVTSGSERPCGKTSWDARTPWAEGGPLVLEAQNPRPTRLCDLFITGEDFDDDV

SEQ ID NO: 10606 - protein, 271 aa, Homo sapiens
MQSARAWLPGDCTSRDGVASAFSGATLLQLPPLPGAPGKKECQVDMQSLWREAVLFAEFPRHGAPASELPVPSGSEMDGAESGKAYGEGSGADCRRHVQKLNLLQGQVSELPLRSLEETVSASEEENVGHQQAGNVKQQEKSQPSESRWLKYLEKDSQELELEGTGVCFSKQPSSKMEEPGPRFSQDLPRKRKWSRSTVQPPCSRGVQDSGGSEVAWGPQKGQAGLTWKVKQGSSPCLQENSADCSAGELRGPGKELWSPIQQDGYKEILF

SEQ ID NO: 10607 - protein, 176 aa, Homo sapiens
MAAAGRGREQDSARFVYVTRFGSHQCSGVLQLGGRGAQGLWGQGPGAGCRQEKPREAMAVAGVQGGSELPLGSQLRVPTTPGVEAAASASSQLRASRVQSGTRQSARAGLIQKDAAKKYDFPIPLNEASKIMKKKKKVLVWNRVYKVISRMLEENEKYRHRLKCQRLSSESSNYTR

SEQ ID NO: 10608 - protein, 134 aa, Homo sapiens
MASGKDTCPTLPKLTNNCSDESLYKSANKYEEIHLPRFSLKQGMIPRRYVMPWKENMIFRNVNLKQAEVCGIHTGPLEDSLFLNHSERLCHGEDRKVVFQKGPPEIKIADMPLHSPLSRYQSTVISHGFRRRLV

SEQ ID NO: 10609 - protein, 147 aa, Homo sapiens
MEDDEEETTASTLRGKPRPPPVSAQSAFSYIPPRRLDPKEHSYYYRPARTGIISLYDCIFKRRLDYDQKLHRDDREHAKSLGLHVNEEEQERPVGVLTSSVYGKRINQPIEPLNRDFGRANHVQADFYRKNDIPSLKEPGFGHIAPS

SEQ ID NO: 10610 - protein, 156 aa, Homo sapiens
MATQQVDSRRQVAAEQVAAQLLERRRGSHCDDEKQTLLALLILVLYLSTEIWGSSWEVSERIRECNYYQNLAVPQGLEYQTNEPSEEPIKTIRNWLKEKLHVFSEKLEEEVQQLEQLAWDLELWLDALLGEPHQEEHCSTYKSHLHLEHEVSIRDH

SEQ ID NO: 10611 - protein, 294 aa, Homo sapiens
MAAAVSSVVRRVEELGDLAQAHIQQLSEAAGEDDHFLIRASAALEKLKLLCGEEKECSNPSNLLELYTQAILDMTYFEENKLVDEDFPEDSSSQKVKELISFLSEPEILVKENNMHPKHCNLLGDELLECLSWRRGALLYMYCHSLTKRREWLLRKSSLLKKYLLDGISYLLQMLNYRCPIQLNEGVSFQDLDTAKLLSAGIFSDIHLLAMMYSGEMCYWGSKYCADQQPENHEVDTSVSGAGCTTYKEPLDFREVGEKILKKYVSVCEGPLKEQEWNTTNAKQILNFFHHRCN

SEQ ID NO: 10612 - protein, 159 aa, Homo sapiens
MTQPTRPSVTCDQGSSTIGGTAAQATTSSSATSGSNYQRDRLGRRPEIGVGGQPQICFPRPRSAQQPVLFSLMNSSEAAMKKTLPKSHLSRVIIHDNRITQRIYEMEVSALEKTKKKISHYYEHLKKKFMTEQLRKLGRWREESVNSNRYLTFGIPPPV

SEQ ID NO: 10613 - protein, 594 aa, Homo sapiens
MSKKRKWDDDYVRYWFTCTTEVDGTQRPQCVLCNSVFSNADLRPSKLSDHFNRQHGGVAGHDLNSLKHMPAPSDQSETLKAFGVASHEDTLLQASYQFAYLCAKEKNPHTVAEKLVKPCALEIAQIVLGPDAQKKLQQVPLSDDVIHSRIDEMSQDILQQVLEDIKASPLKVGIQLAETTDMDDCSQLMAFVRYIKEREIVEEFLFCEPLQLSMKGIDVFNLFRDFFLKHKIALDVCGSVCTDGASSMLGENSEFVAYVKKEIPHIVVTHCLLNPHALVIKTLPTKLRDALFTVVRVINFIKGRAPNHRLFQAFFEEIGIEYSVLLFHTEMRWLSRGQILTHIFEMYEEINQFLHHKSSNLVDGFENKEFKIHLAYLADLFKHLNELSASMQRTGMNTVSAREKLSAFVRKFPFWQKRIEKRNFTNFPFLEEIIVSDNEGIFIAAEITLHLQQLSNFFHGYFSIGDLNEASKWILDPFLFNIDFVDDSYLMKNDLAELRASGQILMEFETMKLEDFWCAQFTAFPNLAKTALEILMPFATTYLCELGFSSLLHFKTKSRSCFNLSDDIRVAISKKVPRFSDIIEQKLQLQQKSL

SEQ ID NO: 10614 - protein, 594 aa, Homo sapiens; identical to SEQ ID NO: 10613

SEQ ID NO: 10615 - protein, 102 aa, Homo sapiens
MREIAEILPAQEKVEARIDLKMGKKRVTDHKLNVDKVIKNINTISSELKKIKELSQLLLCDLILHFNHPIKTENLAEAERNNPLFEESKISDVSLVSNSFSI

SEQ ID NO: 10616 - protein, 102 aa, Homo sapiens; identical to SEQ ID NO: 10615

SEQ ID NO: 10617 - protein, 277 aa, Homo sapiens
MPRAQLPEDSSAVDMDILFPLDSVIGTELCPSPIPQIIHFVLFVVFSLVILIILRLYIPREPSSVPPREEDSENDQAEVGEWLRIGNKYITLKDYRILLKELENLEIYTFLSKKCLKKLSREGSSHHLPRQVRPGPVYKPAPARNHRPRGGRGKASPTSFHVSPRAPLAPLASMPSSVPKTSVESLGSPSSLSSSKPREPLCPLKHPSHQPPASTLSPNPTSSTESLGETPHAGRWRQGSRFPQPGCANAAGRIRHQNPRHSHGHRISDIHEQLGIS

SEQ ID NO: 10618 - protein, 115 aa, Homo sapiens
MLWFQGNSMQLARSSFGLFLRNCSASKTTLPVLTLFTKDPCPLCDEAKEVLKPYENRFILQEVNITLPENSVWYERYKFDIPVFHLNGQFLMMHRVNTSKLEKQLLKLEQQSTGG

SEQ ID NO: 10619 - protein, 138 aa, Homo sapiens
MLWFQGNSMQLARSSFGLFLRNCSASKTTLPVLTLFTKDPCPLCDEAKEVLKPYENRQPYKDQKLPGTRRRRSPSSPSHPHMASQSGKRYNLTLNQVLSFDYDMGLDAPKTISSDCGAFYCLRMFKSPDMTCCFYPKQ

SEQ ID NO: 10620 - protein, 1015 aa, Homo sapiens
MLTALAPPALPGIPRQLPTAPARRQDSSGSSGSYYTAPGSPEPPDVGPDAKGPANWPWVAPGRGAGAQPRLSVSAQNSRQRHGPGSGFPRGPGSGPRPPQPQLRTLPSGEMEVIFGVGPLFGCSGADDREAQQQFTEPAFISPLPPGPASPAAVPRQSQVPDGGSRWATYLELRPRGPSPAAPAQFECVEVALEEGAAPARPRTVPKRQIELRPRPQSPPRAAGAPRPRLLLRTGSLDESLGPLQAAAGFVQTALARKLSPEAPAPSSATFGSTGRSEPETRETARSTHVVLEKAKSRPLRVRDNSAPAKAPRPWPSLRERAIRRDKPAPGTEPLGPVSSSIFLQSEEKIQEARKTRFPREAPDRTVQRARSPPFECRIPSEVPSRAVRPRSPSPPRQTPNGAVRGPRCPSPQNLSPWDRTTRRVSSPLFPEASSEWENQNPAVEETVSRRSPSPPILSQWNQCVAGERSPSLEAPSLWEIPHSAVADAVEPRSSPSPPAFFPWEAPDRPIGTWGPSPQETWDPMGPGSSIAFTQEAQNGLTQEELAPPTPSAPGTPEPTEMQSPSTREISDLAFGGSQQSPEVAAPEPPGSHPVGTLDADKCPEVLGPGEAASGRPRMAIPRPRDVRKLVKTTYAPGFPAGAQGSGLPAPPADPCGEEGGESKTQEPPALGPPAPAHYTSVFIKDFLPVVPHPYEPPEPSFDTVARDASQPNGVLRRRAENSTAKPFKRTEIRLPGALALGRRPEVTSRVRARGPGGENRDVEAQRLVPDGDGRTSPLGGARSSSQRSPVGPAGVRSPRPGSPQMQASPSPGIAPKPKTPPTAPEPAAAVQAPLPREPLALAGRTAPAQPRAASAPPTDRSPQSPSQGARRQPGAAPLGKVLVDPESGRYYFVEAPRQPRLRVLFDPESGQYVEVLLPPSSPGPPHRVYTPLALGLGLYPPAYGPIPSLSLPPSPGPQALGSPQLPWVSEAGPLDGTYYLPVSGTPNPAPPLLLCAPPSSSGPTQPGKGSLFPL

SEQ ID NO: 10621 - protein, 562 aa, Homo sapiens
MTVLEITLAVILTLLGLAILAILLTRWARRKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTLGPIVQYPGSNVRSHPHTITGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10622 - protein, 563 aa, Homo sapiens
MTVLEITLAVILTLLGLAILAILLTRWARRKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPIKLSQKTIVQTLGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10623 - protein, 193 aa, Homo sapiens
MTVLEITLAVILTLLGLAILAILLTRWARRKQSEMHISRYSSEQSARLLDYEDGRGSRHAYSTQSDTSCDNRERSKRDYTPSTNSLVSMASKFSLGQTELILLLMCFILALSRSSIGSIKCLQTTEELPSRTAGAMMQFTAPIPGATGPIKLSQKTIVQTPGPIVQYPGPNAGPPSAPRGPPMAPIIISQRTA

SEQ ID NO: 10624 - protein, 192 aa, Homo sapiens
MTVLEITLAVILTLLGLAILAILLTRWARRKQSEMHISRYSSEQSARLLDYEDGRGSRHAYSTQSDTSCDNRERSKRDYTPSTNSLALSRSSIALPQGSMSSIKCLQTTEELPSRTAGAMMQFTAPIPGATGPIKLSQKTIVQTPGPIVQYPGPNVRSHPHTITGPPSAPRGPPMAPIIISQRTASQLAAPI

SEQ ID NO: 10625 - protein, 192 aa, Homo sapiens; identical to SEQ ID NO: 10624

SEQ ID NO: 10626 - protein, 562 aa, Homo sapiens
MTVLEITLAVILTLLGLAILAILLTRWARRKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTLGPIVQYPGSNVRSHPHTITGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10627 - protein, 193 aa, Homo sapiens; identical to SEQ ID NO: 10623

SEQ ID NO: 10628 - protein, 562 aa, Homo sapiens
MTVLEITLAVILTLLGLAILAILLTRWARRKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPFKLSQKTIVQTLGPIVQYPGSNVRSHPHTITGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKQRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10629 - protein, 563 aa, Homo sapiens
MTVLEITLAVILTLLGLAILAILLTRWARRKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPIKLSQKTIVQTLGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10630 - protein, 563 aa, Homo sapiens
MTVLEITLAVILTLLGLAILAILLTRWARRKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPFKLSQKTIVQTLGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKQRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10631 - protein, 562 aa, Homo sapiens
MTVLEITLAVILTLLGLAILAILLTRWARRKQSEMHISRYSSEQSARLLDYEDGRGSRHAYSTQSDTSCDNRERSKRDYTPSTNSLALSRSSIALPQGSMSSIKCLQTTEELPSRTAGAMMQFTAPIPGATGPIKLSQKTIVQTPGPIVQYPGPNVRSHPHTITGPPSAPRGPPMAPIIISQRTASQLAAPIRIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10632 - protein, 563 aa, Homo sapiens
MTVLEITLAVILTLLGLAILAILLTRWARRKQSEMHISRYSSEQSARLLDYEDGRGSRHAYSTQSDTSCDNRERSKRDYTPSTNSLVSMASKFSLGQTELILLLMCFILALSRSSIGSIKCLQTTEELPSRTAGAMMQFTAPIPGATGPIKLSQKTIVQTPGPIVQYPGPNAGPPSAPRGPPMAPIIISQRTARIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10633 - protein, 547 aa, Homo sapiens
MTVLEITLAVILTLLGLAILAILLTRWARRKQSEMHISRYSSEQSARLLDYEDGRGSRHAYSTQSERSKRDYTPSTNSLALSRSSIALPQGSMSSIKCLQTTEELPSRTAGAMMQFTAPIPGATGPIKLSQKTIVQTPGPIVQYPGPNAGPPSAPRGPPMAPIIISQRTASQLAAPIRIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 10634 - protein, 62 aa, Homo sapiens
MLQVVQEGNPAPFIINTVKRGRRDRERQRTPWAPHPLGFQGRRYIYESPNHRGKDSSFLAQK

SEQ ID NO: 10635 - protein, 62 aa, Homo sapiens; identical to SEQ ID NO: 10634

SEQ ID NO: 10636 - protein, 62 aa, Homo sapiens; identical to SEQ ID NO: 10634

SEQ ID NO: 10637 - protein, 62 aa, Homo sapiens
MLQVVQEGNPAPFIINTVKRGRRDRERQRTPWAPHPLGFQERRYIYESPNHRGKDSSFLAQK

SEQ ID NO: 10638 - protein, 62 aa, Homo sapiens; identical to SEQ ID NO: 10637

SEQ ID NO: 10639 - protein, 62 aa, Homo sapiens; identical to SEQ ID NO: 10637

SEQ ID NO: 10640 - protein, 235 aa, Homo sapiens
MHEHATPVTSAYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENI

SEQ ID NO: 10641 - protein, 713 aa, Homo sapiens
TDEQTDFGLGDAHQSDGLNLEREIVSQTTATQEKSQEELPTTNNSVSKEIWLDFEDFCVCFQNIYIFHKPSSYCLNFQKSEFKFSEERVSYYLFVDSLKPIELLVCFSALVRWGEYGALTKDSPPIEPGLLTAETFSWKSLKPGSLVLKIHTYATKATVVRLPVGRHMLLFNAYSPVGHSIHICSMVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSYGERHEELINLGSPDSHTISEGQKSSVTSKTTRKGKEKSSEKEKTAKEKQAPRFEPQISTVHPQQEDPNKPYWILRLLRLVCITLAGSLRKHLMLRVRLYLKAKLNQKKK

SEQ ID NO: 10642 - protein, 1667 aa, Homo sapiens
MASKQTKKKEVHRINSAHGSDKSKDFYPFGSNVQSGSTEQKKGKFPLWPEWSEADINSEKWDAGKGAKEKDKTGKSPVFHFFEDPEGKIELPPSLKIYSWKRPQDILFSQTPVVVKNEITFDLFSANEHLLCSELMRWIISEIYAVWKIFNGGILSNYFKGTSGEPPLLPWKPWEHIYSLCKAVKGHMPLFNSYGKYVVKLYWMGCWRKITIDDFLPFDEDNNLLLPATTYEFELWPMLLSKAIIKLANIDIHVADRRELGEFTVIHALTGWLPEVISLHPGYMDKVWELLKEILPEFKLSDEASSESKIAVLDSKLKEPGKEGKEGKEIKDGKEVKDVKEFKPESSLTTLKAPEKSDKVPKEKADARDIGKKRSKDGEKEKFKFSLHGSRPSSEVQYSVQSLSDCSSAIQTSHMVVYATFTPLYLFENKIFSLEKMADSAEKLREYGLSHICSHPVLVTRSRSCPLVAPPKPPPLPPWKLIRQKKETVITDEAQELIVKKPERFLEISSPFLNYRMTPFTIPTEMHFVRSLIKKGIPPGSDLPSVSETDETATHSQTDLSQITKATSQGNTASQVILGKGTDEQTDFGLGDAHQSDGLNLEREIVSQTTATQEKSQEELPTTNNSVSKEIWLDFEDFCVCFQNIYIFHKPSSYCLNFQKSEFKFSEERVSYYLFVDSLKPIELLVCFSALVRWGEYGALTKDSPPIEPGLLTAETFSWKSLKPGSLVLKIHTYATKATVVRLPVGRHMLLFNAYSPVGHSIHICSMVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSSKHILSFHSASKKEQEVYVKKKAAQGIQKSPKGRAVSAIQDIGLPLVEEETTSTPTREDSSSTPLQNYKYIIQCSVLYNSWPLTESQLTFVQALKDLKKSNTKAYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLETLAAQEAAMKLETEKMTPAPDTQKKKKGKKK

SEQ ID NO: 10643 - protein, 50 aa, Homo sapiens
MLRSTFTVHWTTILGICRPIKPIYKSQACPLSEKRNADNHLVSEDNTFKV

SEQ ID NO: 10644 - protein, 98 aa, Homo sapiens
MLRSTFTVHWTTILGICRPIKPIYKSQACPLSEKRNADNHLVSEDNTFKEPERYISSSCVLTSILYLGEKTFSFRTLISPRGMKLVEILQQPSLTMVA

SEQ ID NO: 10645 - protein, 81 aa, Homo sapiens
MNVDHEVNLLVEEIHRLGSKNADGKLSVKFGVLFRDDKCANLFEALVGTLKAAKRRKIVTYPGELLLQGVHDDVDIILLQD

SEQ ID NO: 10646 - protein, 67 aa, Homo sapiens
MNVDHEVNLLVEEIHRLGSKSKYLTEIEYFSWLYLGTGETGMLEKPMKGSPRASGHRSGSSAHSPRL

SEQ ID NO: 10647 - protein, 469 aa, Homo sapiens
MAEEREPELYLKWKHCETPGVKTLCNLKHCETPGVKTLCNLKKLLNRLQKDHREDVYLYISGHLNPNKLYQPPETILQHWPNAHRPKGERASEVGEPPAGKVARMKEALAHFTIHTALVPSEAQDTPLFRYLNPQASLSHTSEEDFLPVEAVREGKEEKKGGPPGRGPPGWRRREELRLPDLKVLCYQEAGSRGTRDRHHYVSSYLAGATSADRYRMFLRFQKEVLAKQDLLKNDFTGSKAAAGHERKLQQELQKICTCSPQQFNRLHVFGKVFEDICNSSLIFGDLLKKVKDEYELYMATLLESQPAAQYEALLAQLKALGQRPVKTADMDLAREELRMLVTATKAALEQNDRLRSELEMEVALLQSAKERSESSEKHIIDENRLTLTEKVEKKRCEILSKWDEIQALEKEIKTTLVHTGISDITENRIKSIEHEAIQLETENMILKKKIKGPLEIYQGICKIRGNRR

SEQ ID NO: 10648 - protein, 303 aa, Homo sapiens
MKEALAHFTIHTALVPSEAQDTPLFRYLNPQASLSHTSEEDFLPVEAVREGKEEKKGGPPGRGPPGWRRREELRLPDLKVLCYQEAGSRGTRDRHHYVSSYLAGATSADRYRMFLRFQKEVLAKQDLLKNDFTGSKAAAGHERKLQQELQKICTCSPQQFNRLHVFGKVFEDICNSSLIFGDLLKKVKDEYELYMATLLESQPAAQYEALLAQLKALGQRPVKTADMDLAREELRMLVTATKAALEQNDRLRSELEMEVALLQSAKERSGRCLCDVLPYGCFAVTFIISAAAVWLPVCQLGRC

SEQ ID NO: 10649 - protein, 57 aa, Homo sapiens
MGTAVGPHHSPAPHDSALPARLLTSDFPYGRSCQIEQVKYSVPDTGLFQHWEGSIPT

SEQ ID NO: 10650 - protein, 57 aa, Homo sapiens; identical to SEQ ID NO: 10649

SEQ ID NO: 10651 - protein, 153 aa, Homo sapiens
MAAALALVAGVLSGAVLPLWSALPQYKKKITDRCFHHSECYSGCCLMDLDSGGAFCAPRARITMICLPQWLELFKGRDRIIFIYEAPTPSLVSAHNQGSYQHHLPLPDGLDVHIQGLDVFPPVPYDLEEDAGWSLLPWGHRPWLPPTCSKSSS

SEQ ID NO: 10652 - protein, 181 aa, Homo sapiens
MYQPSRGAARRLGPCLRAYQARPQLPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 10653 - protein, 315 aa, Homo sapiens
MYQPSRGAARRLGPCLRAYQARPQDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 10654 - protein, 433 aa, Homo sapiens
LPTCALQRVDRLGVAGAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 10655 - protein, 181 aa, Homo sapiens; identical to SEQ ID NO: 10652

SEQ ID NO: 10656 - protein, 181 aa, Homo sapiens; identical to SEQ ID NO: 10652

SEQ ID NO: 10657 - protein, 181 aa, Homo sapiens; identical to SEQ ID NO: 10652

SEQ ID NO: 10658 - protein, 315 aa, Homo sapiens; identical to SEQ ID NO: 10653

SEQ ID NO: 10659 - protein, 315 aa, Homo sapiens; identical to SEQ ID NO: 10653

SEQ ID NO: 10660 - protein, 433 aa, Homo sapiens; identical to SEQ ID NO: 10654

SEQ ID NO: 10661 - protein, 315 aa, Homo sapiens; identical to SEQ ID NO: 10653

SEQ ID NO: 10662 - protein, 315 aa, Homo sapiens; identical to SEQ ID NO: 10653

SEQ ID NO: 10663 - protein, 433 aa, Homo sapiens; identical to SEQ ID NO: 10654

SEQ ID NO: 10664 - protein, 433 aa, Homo sapiens; identical to SEQ ID NO: 10654

SEQ ID NO: 10665 - protein, 315 aa, Homo sapiens; identical to SEQ ID NO: 10653

SEQ ID NO: 10666 - protein, 433 aa, Homo sapiens
LPTCALQRVDRLGVAEAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 10667 - protein, 433 aa, Homo sapiens; identical to SEQ ID NO: 10654

SEQ ID NO: 10668 - protein, 181 aa, Homo sapiens; identical to SEQ ID NO: 10652

SEQ ID NO: 10669 - protein, 181 aa, Homo sapiens; identical to SEQ ID NO: 10652

SEQ ID NO: 10670 - protein, 496 aa, Homo sapiens
MYQPSRGAARRLGPCLRAYQARPQVSGGEEGGRRGGGERPSSKPVRGAERALGSAQAQRHPPPLPTCALQRVDRLGVAGAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 10671 - protein, 496 aa, Homo sapiens; identical to SEQ ID NO: 10670

SEQ ID NO: 10672 - protein, 496 aa, Homo sapiens; identical to SEQ ID NO: 10670

SEQ ID NO: 10673 - protein, 496 aa, Homo sapiens; identical to SEQ ID NO: 10670

SEQ ID NO: 10674 - protein, 496 aa, Homo sapiens
MYQPSRGAARRLGPCLRAYQARPQVSGGEEGGRRGGGERPSSKPVRGAERALGSAQAQRHPPPLPTCALQRVDRLGVAEAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 10675 - protein, 496 aa, Homo sapiens; identical to SEQ ID NO: 10670

SEQ ID NO: 10676 - protein, 244 aa, Homo sapiens
MNDPFARMETRGPQGAANPMDSSRSLGDLGPFPREVGRGAPLAPGARNPATAGASRSQGGGHEDRTADRALGPRAGEELDRESWVREKVLFLLHPERWLGTRGDPAREEVAGAEDLPHAGGEDHGEEPNYPSVFQRQKRISGRRVAPPRDAADPPKYVLVRVEDYQVTQEVLQTSWAKGRMTTRTEEHFVTALTFRSSREGQPGERWGPAESRALQARTGASRVHAAGRRVSPSPGTWLEEIKL

SEQ ID NO: 10677 - protein, 508 aa, Homo sapiens
MGRRNENCANSLRVSNISQENLSHWNLDSEVPVSENKNLPAGRDGAAGGKINKNYLEIPVEQLMLEPNLSVHSQKSTQNSKQGIFQLWNCPLNEGSTIEKREFKKSSVETGFNVINHPIRVFTLNHPLTIASVDKQVGPYPGLPMPLGLCWPYADGDFFKNRNEIHVSSCSTIENNDGETLPAPNWNLKHGNSSVEENFTDESDLSENEKTNDTLLSYFKKVDLNLKPETIKNVEEPFTEEPNEVFPYPDFLPPPFSALDLHNLALSKSDNWKVTVDPAETSVEHLITRLLELERLQHMTIQKERPRLQTTFCTPAVTERPSSSKATPKVRQPKLCDSLSLQIPCVDKSQEKSKNNSGSCKLEQNALKRNWSNAGKYRWNSRPLSLKSSSTPKQLIETYDKNPKSSILSPCQELSFKPTIGHTNQSMVKMVSTRCLPWRSPMPVSPIPLTFPENQKEEIKAPKRNFGTKKKLYRQNIVLNRPFSIQKLNCLSPSLIAKDKCCSPIEQK

SEQ ID NO: 10678 - protein, 355 aa, Homo sapiens
MLMEFFKNRNEIHVSSCSTIENNDGETLPAPNWNLKHGNSSVEENFTDESDLSENEKTNDTLLSYFKKVDLNLKPETIKNVEEPFTEEPNEVFPYPDFLPPPFSALDLHNLALSKSDNWKVTVDPAETSVEHLITRLLELERLQHMTIQKERPRLQTTFCTPAVTERPSSSKATPKVRQPKLCDSLSLQIPCVDKSQEKSKNNSGSCKLEQNALKRNWSNAGKYRWNSRPLSLKSSSTPKQLIETYDKNPKSSILSPCQELSFKPTIGHTNQSMVKMVSTRCLPWRSPMPVSPIPLTFPENQKEEIKAPKRNFGTKKKLYRQNIVLNRPFSIQKLNCLSPSLIAKDKCCSPIEQK

SEQ ID NO: 10679 - protein, 325 aa, Homo sapiens
MQGRVAGSCAPLGLLLVCLHLPGLFARSIGVVEEKVSQNFGTDLPQLGQPSSTGPSNSEHPQPALDPRSNDLARVPLKLSVPPSDGFPPAGGSAVQRWPPSWGLPAMDSWPPEDPWQMMAAAAEDRLGEALPEELSYLSSAAALAPGSGPLPGESSPDATGLSPEASLLHQDSESRRLPRSNSLGAGGKILSQRPPWSLIHRVLPDHPWGTLNPSVSWGGGGPGTGWGTRPMPHPEGIWGINNQPPGTSWGNINRYPGGSWGNINRYPGGSWGNINRYPGGSWGNIHLYPGINNPFPPGVLRPPGSSWNIPAGFPNPPSPRLQWG

SEQ ID NO: 10680 - protein, 325 aa, Homo sapiens [sequence omitted]

SEQ ID NO: 10681 - protein, 203 aa, Homo sapiens
MYQNMDDEMKREHLAAEQRMVHRIQRIMMECHREKVEAVEKARAEERHIAQEAIQAQKSKAVEEIVNTGVTVIKDEKTSVARLMREKEHEMSILYGIAQRQRQEEVQEVLQEAEKTHQATLGNMMDKLANTQGELLSIAKQLGIMTNWKDFLEEELQETRMAFQKYINYTFPKLSPGHADFILPERKKTPSNLVIKENKTTLD

SEQ ID NO: 10682 - protein, 329 aa, Homo sapiens
MIRNSDYKNFVCCAVCNKIIPPAPFGKTFKRIHEYKPLKTRFYTHKDILDIGANILKKEEQFQEDILREHIAKAEAEVWAQANERQKQAVEKALEEANDRHKIEIQILKEEHQKDLQEVTAKTKTEMYQNMDDEMKREHLAAEQRMVHRIQRIMMECHREKVEAVEKARAEERHIAQEAIQAQKSKAVEEIVNTGVTVIKDEKTSVARLMREKEHEMSILYGIAQRQRQEEVQEVLQEAEKTHQATLGNMMDKLANTQGELLSIAKQLGIMTNWKDFLEEELQETRMAFQKYINYTFPKLSPGHADFILPERKKTPSNLVIKENKTTLD

SEQ ID NO: 10683 - protein, 76 aa, Homo sapiens
MSHLPAVSPVFFQLPAPHPPTVLRPQLGLHPNPECDREKMSVRDHDPEVLTRNSACKPRGQLSGHLLKPRAPLEAA

SEQ ID NO: 10684 - protein, 59 aa, Homo sapiens
MSHLPAVSPVFFQLPAPHPPTVLRPQLGLHPNPECDREKMSVRDHDPEVLTRNSGSLQA

SEQ ID NO: 10685 - protein, 622 aa, Homo sapiens
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPATMQHIDYQLETARSQVYRYTAILEKAANDPLMRAELQPYMLKEALYNIRQYEVFLQIILSDIITGAQEVEMMTKQLGAHLEQLKMTIKSKIAVPTSQVFPIFIALSTLWTSLQDETIVVGVLSNLFTHIQPFLGAHELYFPERVMQCHLNGATVKTDVCRMKEHMEDRVNVADFRKLEWLFPETTANFDKLLIQYRGFCAYTFAATDGLLLPGNPAIGILKYKEKYYTFNSKDAAYSFAENPEHYIDIVREKAKKNTELIQLLELHQQFETFIPYSQMRDADKHYIKPITKCESSTQTNTHILPPTIVRSYEWNEWELRRKAIKLANLRQKVTHSVQTDLSHLRRENCSQVYPPKDTSTQSMREDSTGVPRPQIYLAGLRGGKSEITDEVKVNLTRDVDET

SEQ ID NO: 10686 - protein, 252 aa, Homo sapiens
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPATMQHIDYQLETARSQVYRYTAILEKAANDPL

SEQ ID NO: 10687 - protein, 409 aa, Homo sapiens
MHWGVGFASSRPCVVDLSWNQSISFFGWWAGSEEPFSFYGDIIAFPLQDYGGIMAGLGSDPWWKKTLYLTGGALLAAAAYLLHELLVIRKQQEIDSKDAIILHQFARPNNGVPSLSPFCLKMETYLRMADLPYQNYFGGKLSAQGKMPWIEYNHEKVSGTEFIIDFLEEKLGVNLNKNLGPHERAISRAVTKMVEEHFYWTLAYCQWVDNLNETRKMLSLSGGGPFSNLLRWVVCHITKGIVKREMHGHGIGRFSEEEIYMLMEKDMRSLAGLLGDKKYIMGPKLSTLDATVFGHLAQAMWTLPGTRPERLIKGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 10688 - protein, 129 aa, Homo sapiens
MGPKLSTLDATVFGHLAQAMWTLPGTRPERLIKGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 10689 - protein, 127 aa, Homo sapiens
MIYPLDLFRNIPWKQGKCFASLSPEGERAFDGMEPLCQPGARPALRGLQHASDCYRLLSPPGSGLVGTNPSVPAPSPHCGCCQAWSISSFTFTGPTPFKINSDQATPCHLRSPETIFRQREISNEAF

SEQ ID NO: 10690 - protein, 143 aa, Homo sapiens
MASGPLGPGARPTRLHPPFPPPAHIKPGAPPGENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTGKSQCLLGISEPT

SEQ ID NO: 10691 - protein, 128 aa, Homo sapiens
MLSNLHELLPNHLMETLYSRKSEEDKKKCENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTE

SEQ ID NO: 10692 - protein, 196 aa, Homo sapiens
MLSNLHELLPNHLMETLYSRKSEEDKKKCENPELSGLERILARHQLPKEINLTPKPNRMPPWKRKIINNVTDGWKKCHLLKRNTKEPPMSTIVVRWLKKNMQPTEDLKSVICRLSAFGPIQSATVCGRQSAIVAFKDMTSACNAVSAFQSRTPGTMFQCSWQQRFMSKDKTYSKKCTQKTQPKEYKQETEKPANNS

SEQ ID NO: 10693 - protein, 140 aa, Homo sapiens
MLSNLHELLPNHLMETLYSRKSEEDKKKCENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTGKSQCLLGISEPT

SEQ ID NO: 10694 - protein, 441 aa, Homo sapiens
MAVVPASLSGQDVGSFAYLTIKDRIPQILTKVIDTLHRHKSEFFEKHGEEGVEAEKKAISLLSKLRNELQTDKPFIPLVEKFVDTDIWNQYLEYQQSLLNESDGKSRWFYSPWLLVECYMYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 10695 - protein, 322 aa, Homo sapiens
MYRRIHEAIIQSPPIDYFDVFKESKEQNFYGSQESIIALCTHLQQLIRTIEDLDENQLKDEFFKLLQISLWGNKCDLSLSGGESSSQNTNVLNSLEDLKPFILLNDMEHLWSLLSNCKKTREKASATRVYIVLDNSGFELVTDLILADFLLSSELATEVHFYGKTIPWFVSDTTIHDFNWLIEQVKHSNHKWMSKCGADWEEYIKMGKWVYHNHIFWTLPHEYCAMPQVAPDLYAELQKAHLILFKGDLNYRKLTGDRKWEFSVPFHQALNGFHPAPLCTIRTLKAEIQVGLQPGQGEQLLASEPSWWTTGKYGIFQYDGPL

SEQ ID NO: 10696 - protein, 652 aa, Homo sapiens
MENPRCPRRPLAEKKARSLDRPQAPGKGSESWDCHWLSLPTAPSRKALHWTTSDWARHSDSPAPSAEAHCTTAAAPTPEETGDFLPSEQRPSQDTKKGWLKTMLNFFVRTGPEEPREKASRRPRGKEGISQHPEPLEAAGEPALRKKAHHDKKPSRKKQGHKKHAAEVTKAAQDQEARGREEGLSKAAAALRSGEADLGPARRGGEDSDHQSFLIKVDGTGALDVSPHATGHQQEEELKKPDQDAIIQMIVELLKRVGDQWEEEQSLASQLGVALPNPAPAVRKKSQEKKTSLKRTSKTNPKKHGSEEAKRGAADVSSPEAWPPKKSSFLPLCVSGHRPSISSSYGLEEPKVQEAPSTEAGAPGPSVLPTPSESQEPGEELPLDRASEYKEFIQKIISMLQDAEEQQGEEQPQVQQEEVGVENPAPHCRRKSQEKRSSFRRAFYHKKHTSKEPRRAGAAGAASPEARRPKRPSFLPLCVGGHRPSTSSSLDPEDLECREPLPAEGEPVVISEAPSQARGHTPEGAPQLSGACESKEIIIQKLVALLQEVDGQLGQQIRRHPSFKRFFYEFSDSSLSKLVATLRSQVAHSSKLDRNRARRLYQFDVSLANKFAGSNSHAMCILMGLRDHYNCTQFPYREDQPNITSPKVESPD

SEQ ID NO: 10697 - protein, 242 aa, Homo sapiens
MMPLAEAGALAQGGGPSATEWACILRRKTPRHKQPTLLMVRASRRSGKTSAVLKAGRQSVSGRKNSTSKDLVTLGASSLREERGHPLHPRHRKAVHLRTRGRTRGWVQTLARMSRRTRGPVERAAAAAAAAAGGDAGHAPFPPPPAADGARAPRSPGQVTPRGLRLRLPRRESLLRGLCRPLRPLLGFRESDSAKPASLRLLQHTPSARRNYRIAGARLMRSNYPPPLSSAALRGAGPTRRN

SEQ ID NO: 10698 - protein, 105 aa, Homo sapiens
MMPLAEAGALAQGGGPSATEWACILRRLLRKEGVDGGLFSPEDPQAQAAHLTDGQSIQKKWQDFSCPQSRKTECFWQKEQHKQRSGNPRCLQFEGGERTPPPPQT

SEQ ID NO: 10699 - protein, 80 aa, Homo sapiens
MPFQFGTQPRRFPVEGGDSSIELEPGLSSSAACNGKEMSPTRQLRRCPGSHCLTITDVPVTVYATTRKPPAQSSKEMHPK

SEQ ID NO: 10700 - protein, 101 aa, Homo sapiens
MERPRSPQCSAPASASASVTLAQLLQLVQQGQELPGLEKRHIAAIHGEPTASRLPRRPKPWEAAALAESLPPPTLRIGTAPAEPGLVEAATAPSSWHTVGP

SEQ ID NO: 10701 - protein, 91 aa, Homo sapiens
MWHSVGLTLLVFVATLLIVLLLMVCGWYFVWHLFLSKFKFLRELVGDTGSQEGDHEPSGSETEEDTSSSPHRIRSARQRRAPADEGHRPLT

SEQ ID NO: 10702 - protein, 193 aa, Homo sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHALSPPHSSTCENRAPEASKGGRAQDSRGPGPGTEPALCGSGPSSPQQAPPAVHSGPC

SEQ ID NO: 10703 - protein, 197 aa, Homo sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHAPLVKTEPQRPVKEEEPKIPGDLDQEPSLLYADLDHLALSRPRRLSTADPADASTIYAVVV

SEQ ID NO: 10704 - protein, 237 aa, Homo sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIGPLPRFALSPPHSSTCENRAPEASKGGRAQDSRGPGPGTEPALCGSGPSSPQQAPPAVHSGPC

SEQ ID NO: 10705 - protein, 241 aa, Homo sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIGPLPRFAPLVKTEPQRPVKEEEPKIPGDLDQEPSLLYADLDHLALSRPRRLSTADPADASTIYAVVV

SEQ ID NO: 10706 - protein, 217 aa, Homo sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGACPRNRLDHSLDLLCPPHIAPLVKTEPQRPVKEEEPKIPGDLDQEPSLLYADLDHLALSRPRRLSTADPADASTIYAVVV

SEQ ID NO: 10707 - protein, 294 aa, Homo sapiens
MFLRRLGGWLPRPWGRRKPMRPDPPYPEPRRVDSSSENSGSDWDSAPETMEDVGHPKTKDSGALRVSRAASEPSKEEPQVEQLGSKRMDSLKWDQPISSTQESGRLEAGGASPKLRWDHVDSGGTRRPGVSPEGGLSVPGPGAPLEKPGRREKLLGWLRGEPGAPSRYLGGPEECLQISTNLTLHLLELLASALLALCSRPLRAALDTLGLRGPLGLWLHGLLSFLAALHGLHAVLSLLTAHPLHFACLFGLLQALVLAVSLREPNGDEAATDWESEGLEREGEEQRGDPGKGL

SEQ ID NO: 10708 - protein, 294 aa, Homo sapiens; identical to SEQ ID NO: 10707

SEQ ID NO: 10709 - protein, 294 aa, Homo sapiens
MFLRRLGGWLPRPWGRRKPMRPDPPYPEPRRVDSSSENSGSDWDSAPETMEDVGHPKTKDSGALRVSGAASEPSKEEPQVEQLGSKRMDSLKWDQPISSTQESGRLEAGGASPKLRWDHVDSGGTRRPGVSPEGGLSVPGPGAPLEKPGRREKLLGWLRGEPGAPSRYLGGPEECLQISTNLTLHLLELLASALLALCSRPLRAALDTLGLRGPLGLWLHGLLSFLAALHGLHAVLSLLTAHPLHFACLFGLLQALVLAVSLREPNGDEAATDWESEGLEREGEEQRGDPGKGL

SEQ ID NO: 10710 - protein, 294 aa, Homo sapiens; identical to SEQ ID NO: 10707

SEQ ID NO: 10711 - protein, 294 aa, Homo sapiens; identical to SEQ ID NO: 10707

SEQ ID NO: 10712 - protein, 294 aa, Homo sapiens; identical to SEQ ID NO: 10707

SEQ ID NO: 10713 - protein, 294 aa, Homo sapiens; identical to SEQ ID NO: 10709

SEQ ID NO: 10714 - protein, 311 aa, Homo sapiens
MFLRRLGGWLPRPWGRRKPMRPDPPYPEPRRVDSSSENSGSDWDSAPETMEDVGHPKTKDSGALRVSGAASEPSKEEPQVEQLGSKRMDSLKWDQPISSTQESGRLEAGGASPKLRWDHVDSGGTRRPGVSPEGGLSVPGPGAPLEKPGRREKLLGWLRGEPGAPSRYLGGPEECLQISTNLTLHLLELLASALLALCSRPLRAALDTLGLRGPLGLWLHGLLSFLAALHGLHAVLSLLTAHPLHFACLFGLLQALVLAVSGSPMGMRRPLTGRVRGWRGKVRSRGETRERGCDRGVGAKGEESVGFRRKV

SEQ ID NO: 10715 - protein, 75 aa, Homo sapiens
MERSFVWLSCLDSDSCNLTFRLGEVESHACSPSLLWNLLTQYLPPGAGHILRTYNFPVLSCVSSCHLIGGKMPEN

SEQ ID NO: 10716 - protein, 75 aa, Homo sapiens; identical to SEQ ID NO: 10715

SEQ ID NO: 10717 - protein, 125 aa, Homo sapiens
MRVVMARLLSEGEQGIPTACAAFAQQPAGPRRGLAGVGEGGPQCSWVNYRCTLEFLVSLLGTDLARGRGNSASGPTAPADSKQLMNSGSPARDNAPSQRFCTNLSEGLRFGISPSWREALYGCHA

SEQ ID NO: 10718 - protein, 75 aa, Homo sapiens; identical to SEQ ID NO: 10715

SEQ ID NO: 10719 - protein, 75 aa, Homo sapiens; identical to SEQ ID NO: 10715

SEQ ID NO: 10720 - protein, 75 aa, Homo sapiens; identical to SEQ ID NO: 10715

SEQ ID NO: 10721 - protein, 75 aa, Homo sapiens; identical to SEQ ID NO: 10715

SEQ ID NO: 10722 - protein, 75 aa, Homo sapiens; identical to SEQ ID NO: 10715

SEQ ID NO: 10723 - protein, 75 aa, Homo sapiens; identical to SEQ ID NO: 10715

SEQ ID NO: 10724 - protein, 75 aa, Homo sapiens; identical to SEQ ID NO: 10715

SEQ ID NO: 10725 - protein, 75 aa, Homo sapiens; identical to SEQ ID NO: 10715

SEQ ID NO: 10726 - protein, 75 aa, Homo sapiens; identical to SEQ ID NO: 10715

SEQ ID NO: 10727 - protein, 75 aa, Homo sapiens; identical to SEQ ID NO: 10715

SEQ ID NO: 10728 - protein, 75 aa, Homo sapiens; identical to SEQ ID NO: 10715

SEQ ID NO: 10729 - protein, 75 aa, Homo sapiens; identical to SEQ ID NO: 10715

SEQ ID NO: 10730 - protein, 75 aa, Homo sapiens; identical to SEQ ID NO: 10715

SEQ ID NO: 10731 - protein, 75 aa, Homo sapiens; identical to SEQ ID NO: 10715

SEQ ID NO: 10732 - protein, 75 aa, Homo sapiens; identical to SEQ ID NO: 10715

SEQ ID NO: 10733 - protein, 75 aa, Homo sapiens; identical to SEQ ID NO: 10715

SEQ ID NO: 10734 - protein, 75 aa, Homo sapiens; identical to SEQ ID NO: 10715

SEQ ID NO: 10735 - protein, 75 aa, Homo sapiens; identical to SEQ ID NO: 10715

SEQ ID NO: 10736 - protein, 75 aa, Homo sapiens; identical to SEQ ID NO: 10715

SEQ ID NO: 10737 - protein, 75 aa, Homo sapiens; identical to SEQ ID NO: 10715

SEQ ID NO: 10738 - protein, 75 aa, Homo sapiens; identical to SEQ ID NO: 10715

SEQ ID NO: 10739 - protein, 75 aa, Homo sapiens; identical to SEQ ID NO: 10715

SEQ ID NO: 10740 - protein, 75 aa, Homo sapiens; identical to SEQ ID NO: 10715

SEQ ID NO: 10741 - protein, 75 aa, Homo sapiens; identical to SEQ ID NO: 10715

SEQ ID NO: 10742 - protein, 75 aa, Homo sapiens; identical to SEQ ID NO: 10715

SEQ ID NO: 10743 - protein, 75 aa, Homo sapiens; identical to SEQ ID NO: 10715

SEQ ID NO: 10744 - protein, 75 aa, Homo sapiens; identical to SEQ ID NO: 10715

SEQ ID NO: 10745 - protein, 75 aa, Homo sapiens; identical to SEQ ID NO: 10715

SEQ ID NO: 10746 - protein, 75 aa, Homo sapiens; identical to SEQ ID NO: 10715

SEQ ID NO: 10747 - protein, 75 aa, Homo sapiens; identical to SEQ ID NO: 10715

SEQ ID NO: 10748 - protein, 75 aa, Homo sapiens; identical to SEQ ID NO: 10715

SEQ ID NO: 10749 - protein, 75 aa, Homo sapiens; identical to SEQ ID NO: 10715

SEQ ID NO: 10750 - protein, 75 aa, Homo sapiens; identical to SEQ ID NO: 10715

SEQ ID NO: 10751 - protein, 75 aa, Homo sapiens; identical to SEQ ID NO: 10715

SEQ ID NO: 10752 - protein, 75 aa, Homo sapiens; identical to SEQ ID NO: 10715

SEQ ID NO: 10753 - protein, 75 aa, Homo sapiens; identical to SEQ ID NO: 10715

SEQ ID NO: 10754 - protein, 75 aa, Homo sapiens; identical to SEQ ID NO: 10715

SEQ ID NO: 10755 - protein, 75 aa, Homo sapiens; identical to SEQ ID NO: 10715

SEQ ID NO: 10756 - protein, 75 aa, Homo sapiens; identical to SEQ ID NO: 10715

SEQ ID NO: 10757 - protein, 75 aa, Homo sapiens; identical to SEQ ID NO: 10715

SEQ ID NO: 10758 - protein, 75 aa, Homo sapiens; identical to SEQ ID NO: 10715

SEQ ID NO: 10759 - protein, 75 aa, Homo sapiens; identical to SEQ ID NO: 10715

SEQ ID NO: 10760 - protein, 75 aa, Homo sapiens; identical to SEQ ID NO: 10715

SEQ ID NO: 10761 - protein, 98 aa, Homo sapiens
MRVVMARLLSEGEQGIPTACAAFAQQPAGPRRGLAGVGEGGPQCSWVNYRCTLEFLVSLLGTDLARGRGNSASGPTAPADSKQLSCKTFIAVLSLSKE

SEQ ID NO: 10762 - protein, 125 aa, Homo sapiens; identical to SEQ ID NO: 10717

SEQ ID NO: 10763 - protein, 98 aa, Homo sapiens; identical to SEQ ID NO: 10761

SEQ ID NO: 10764 - protein, 125 aa, Homo sapiens; identical to SEQ ID NO: 10717

SEQ ID NO: 10765 - protein, 98 aa, Homo sapiens; identical to SEQ ID NO: 10761

SEQ ID NO: 10766 - protein, 98 aa, Homo sapiens; identical to SEQ ID NO: 10761

SEQ ID NO: 10767 - protein, 125 aa, Homo sapiens; identical to SEQ ID NO: 10717

SEQ ID NO: 10768 - protein, 125 aa, Homo sapiens; identical to SEQ ID NO: 10717

SEQ ID NO: 10769 - protein, 98 aa, Homo sapiens; identical to SEQ ID NO: 10761

SEQ ID NO: 10770 - protein, 152 aa, Homo sapiens
MAQPESSADFGIAQQNNYYCYWQSLPSAIRVKQEFQPSQSYRYGNWYARQHGSYLLSGYSYGCAVDGNGKDCFSAHETPEHTAGTLVMPKETTPLAENQDEDPLEDPHLHLNIEESNQEFMVKSEELYDSLMNCHWQPLDTVHSEIPDETPK

SEQ ID NO: 10771 - protein, 65 aa, Homo sapiens
MPKETTPLAENQDEDPLEDPHLHLNIEESNQEFMVKSEELYDSLMNCHWQPLDTVHSEIPDETPK

SEQ ID NO: 10772 - protein, 200 aa, Homo sapiens
MSENLSDPVSPVVRKKKSALFEVSEVIPVMTNNYEENILKGVRDSSYSLESSLELLQKDVVQLHAPRYQSMRRDVIGCTQEMDFILWPRNDIEKIVCLLFSRWKESDEPFRPVQAKFEFHHGDYEKQFLHVLSRKDKTGIVVNNPNQSVFLFIDRQHLQTPKNKATIFKLCSICLYLPQEQLTHWAVGTIEDHLRPYMPE

SEQ ID NO: 10773 - protein, 229 aa, Homo sapiens
MGDPNSRKKQALNRLRAQLRKKKESLADQFDFKMYIAFVFKEKKKKSALFEVSEVIPVMTNNYEENILKGVRDSSYSLESSLELLQKDVVQLHAPRYQSMRRDVIGCTQEMDFILWPRNDIEKIVCLLFSRWKESDEPFRPVQAKFEFHHGDYEKQFLHVLSRKDKTGIVVNNPNQSVFLFIDRQHLQTPKNKATIFKLCSICLYLPQEQLTHWAVGTIEDHLRPYMPE

SEQ ID NO: 10774 - protein, 171 aa, Homo sapiens
MTNNYEENILKGVRDSSYSLESSLELLQKDVVQLHAPRYQSMRRDVIGCTQEMDFILWPRNDIEKIVCLLFSRWKESDEPFRPVQAKFEFHHGDYEKQFLHVLSRKDKTGIVVNNPNQSVFLFIDRQHLQTPKNKATIFKLCSICLYLPQEQLTHWAVGTIEDHLRPYMPE

SEQ ID NO: 10775 - protein, 222 aa, Homo sapiens
MAGAEPFLADGNQELFPCEVCGRRFAADVLERHGPICKKLFNRKRKPFSSLKQRLQGTDIPTVKKTPQSKSPPVRKSNWRQQHEDFINAIRSAKQCMLAIKEGRPLPPPPPPSLNPDYIQRPYCMRRFNESAAERHTNFCKDQSSRRVFNPAQTAAKLASRAQGRAQMGPKKEPTVTSAVGALLQNRVLVATNEVPTKSGLAMDPASGAKLRQGFSKSSKKD

SEQ ID NO: 10776 - protein, 154 aa, Homo sapiens
  MOD_RES (1)..(1): Any amino acid
XGNQELFPCEVCGRRFAADVLERHGPICKKLFNRKRKPFSSLKQRLQGTDIPTVKKTPQSKSPPVRKSNWRQQHEDFINAIRSAKQCMLAIKEGRPLPPPPPPSLNPDYIQRPYCMRRFNESAAERHTNFCKDQSSRRVFNPAQTAAKLASRAQ

SEQ ID NO: 10777 - protein, 115 aa, Homo sapiens
PPPPPSLNPDYIQRPYCMRRFNESAAERHTNFCKDQSSRRVFNPAQTAAKLASRAQGRAQMGPKKEPTVTSAVGALLQNRVLVATNEVPTKSGLAMDPASGAKLRQGFSKSSKKD

SEQ ID NO: 10778 - protein, 126 aa, Homo sapiens
MLAIKEGRPLPPPPPPSLNPDYIQRPYCMRRFNESAAERHTNFCKDQSSRRVFNPAQTAAKLASRAQGRAQMGPKKEPTVTSAVGALLQNRVLVATNEVPTKSGLAMDPASGAKLRQGFSKSSKKD

SEQ ID NO: 10779 - protein, 715 aa, Homo sapiens
MSLDCTSHIALGAASPAPEETYDHLSEVPVTREQLNHYRNVAQNARSELAATLVKFECAQSELQDLRSKMLSKEVSCQELKAEMESYKENNARKSSLLTSLRDRVQELEEESAALSTSKIRTEITAHAAIKENQELKKKVVELNEKLQKCSKENEENKKQVSKNCRKHEEFLTQLRDCLDPDERNDKASDEDLILKLRDLRKENEFVKGQIVILEETINVHEMEAKASRETIMRLASEVNREQKKAASCTEEKEKLNQDLLSAVEAKEALEREVKIFQERLLAGQQVWDASKQEVSLLKKSSSELEKSLKASQDAVTTSQSQYFSFREKIAALLRGRLSMTGSTEDTILEKIREMDSREESRDRMVSQLEAQISELVEQLGKESGFHQKALQRAQKAENMLETLQGQLTHLEAELVSGGVLRDNLNFEKQKYLKFLDQLSQKMKLDQMAAELGFDMRLDVVLARTEQLVRLESNAVIENKTIAHNLQRKLKTQKERLESKELHMSLLRQKIAQLEEEKQARTALVVERDNAHLTIRNLQKKVERLQKELNTCRDLHTELKAKLADTNELKIKTLEQTKAIEDLNKSRDQLEKMKEKAEKKLMSVKSELDTTEHEAKENKERARNMIEVVTSEMKTLKKSLEEAEKREKQLADFREVVSQMLGLNVTSLALPDYEIIKCLERLVHSHQHHFVTCACLKDVTTGQERHPQGHLQLLH

SEQ ID NO: 10780 - protein, 722 aa, Homo sapiens
MSLDCTSHIALGAASPAPEETYDHLSEVPVTREQLNHYRNVAQNARSELAATLVKFECAQSELQDLRSKMLSKEVSCQELKAEMESYKENNARKSSLLTSLRDRVQELEEESAALSTSKIRTEITAHAAIKENQELKKKVVELNEKLQKCSKENEENKKQVSKNCRKHEEFLTQLRDCLDPDERNDKASDEDLILKLRDLRKENEFVKGQIVILEETINVHEMEAKASRETIMRLASEVNREQKKAASCTEEKEKLNQDLLSAVEAKEALEREVKIFQERLLAGQQVWDASKQEVSLLKKSSSELEKSLKASQDAVTTSQSQYFSFREKIAALLRGRLSMTGSTEDTILEKIREMDSREESRDRMVSQLEAQISELVEQLGKESGFHQKALQRAQKAENMLETLQGQLTHLEAELVSGGVLRDNLNFEKQKYLKFLDQLSQKMKLDQMAAELGFDMRLDVVLARTEQLVRLESNAVIENKTIAHNLQRKLKTQKERLESKELHMSLLRQKIAQLEEEKQARTALVVERDNAHLTIRNLQKKVERLQKELNTCRDLHTELKAKLADTNELKASAWLHFIKTLEQTKAIEDLNKSRDQLEKMKEKAEKKLMSVKSELDTTEHEAKENKERARNMIEVVTSEMKTLKKSLEEAEKREKQLADFREVVSQMLGLNVTSLALPDYEIIKCLERLVHSHQHHFVTCACLKDVTTGQERHPQGHLQLLH

SEQ ID NO: 10781 - protein, 125 aa, Homo sapiens
MKNEEHCPGSFFLCKIRECVLNYRFQLQHPGFQHYLQSSGRRDRGRSEDKKPLEAGVWCWDRGGWDGSSRAVHLLFRGVAHPSLYLFPREDPPRLLFPRLSLLVCEQFWCYSATLLLAPLPASTC

SEQ ID NO: 10782 - protein, 202 aa, Homo sapiens
MNAAVPPEQAHSCGWGTEGCPCLRSTAIRQTFFPGGDQFQRDGGLAMLPILVSKFLASSDPPVSVPEMLGLQNRWRGMKNEEHCPGSFFLCKIRECVLNYRFQLQHPGFQHYLQSSGRRDRGRSEDKKPLEAGVWCWDRGGWDGSSRAVHLLFRGVAHPSLYLFPREDPPRLLFPRLSLLVCEQFWCYSATLLLAPLPASTC

SEQ ID NO: 10783 - protein, 421 aa, Homo sapiens
MSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKQTLVVDVVANGGHTWVKAIGRKAEALHNIWLGRGQYGDKSIIEQAEDFLQASHQQPVQYSNPHIIFAFYNSVSSPMAEKLKEMGISVRGDIVAVNALLDHPEELQPSESESDDEGPELLQVTRVDRENILASVAFPTEIKVDVCKRVNLDITTLITYVSALSYGGCHFIFKEKVLTEQAEQERKEQVLPQLEAFMKDKELFACESAVKDFQSILDTLGGPGERERATVLIKRINVVPDQPSERALRLVASSKINSRSLTIFGTGDTLKAITMTANSGFVRAANNQGVKFSVFIHQPRALTESKEALATPLPKDYTTDSEH

SEQ ID NO: 10784 - protein, 178 aa, Homo sapiens
MSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKQTLVVDVVANGGHTWVKAIGRKAEALHNIWLGRGQYGDKSIIEQAEDFLQASHQQPVQYSNPHIIFAFYNSVSSPMA

SEQ ID NO: 10785 - protein, 479 aa, Homo sapiens
MQEVPEAAGLARVEPPRRSSGVGAARLRFPGGSRPLRARACVLALAVLALPERNNADSMSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKQTLVVDVVANGGHTWVKAIGRKAEALHNIWLGRGQYGDKSIIEQAEDFLQASHQQPVQYSNPHIIFAFYNSVSSPMAEKLKEMGISVRGDIVAVNALLDHPEELQPSESESDDEGPELLQVTRVDRENILASVAFPTEIKVDVCKRVNLDITTLITYVSALSYGGCHFIFKEKVLTEQAEQERKEQVLPQLEAFMKDKELFACESAVKDFQSILDTLGGPGERERATVLIKRINVVPDQPSERALRLVASSKINSRSLTIFGTGDTLKAITMTANSGFVRAANNQGVKFSVFIHQPRALTESKEALATPLPKDYTTDSEH

SEQ ID NO: 10786 - protein, 85 aa, Homo sapiens
MSAHSMLCERIAIAKELIKRAESLSRSRKGGIEGGAKLCSKLKAELKFLQKVEAGKVAIKESHLQSTNLTHLRAIVESAENLEEV

SEQ ID NO: 10787 - protein, 421 aa, Homo sapiens; identical to SEQ ID NO: 10783

SEQ ID NO: 10788 - protein, 421 aa, Homo sapiens; identical to SEQ ID NO: 10783

SEQ ID NO: 10789 - protein, 449 aa, Homo sapiens
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 10790 - protein, 352 aa, Homo sapiens
MSDIRHSLLRRDALSAAKEVLYHLDIYFSSQLQSAPLPIVDKGPVELLEEFVFQVPKERSAQPKEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 10791 - protein, 236 aa, Homo sapiens
MVVREASAAQASLSQVLPQLRYLHIFLEQVHTHFQEQSVGERGAAIQLAEGLARQLCTDCQLNKLFYREEFVLATLLDPCFKGKIEAILPWGPTDIDHWKQVLVYKVKEIRVSEYSLNSPSPLQSPRGLCVDPTRVAKSSGVEGRSQGEPLQSSSHSGAFLLAQREKGLLESMGLLASERSGGSLSTKSHWASIIVKKYLWENETVGAQDDPLAYWEKKREAWPPSICLTPHRSLL

SEQ ID NO: 10792 - protein, 590 aa, Homo sapiens
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLTQNKKSDVYGNDSLIPKPPNSTVGEICLPYPIEHPYHTHICRGAMFPTFTSPEDLYTGIKARTQQPFPPTVPTKAYDSTVLKTRGNPYRYELIDIPMDSKKKALTWPGQGVYYDFPRGVEKNKPVFYPKPPKTFAPNTSLNSWDPICSAKEANIQRNLERSHWLTSYTHDFTGLGPMDPLELDDYHEKMVAELTRKIGFDPEPQEKFHPVFKPPRPLEGRIARLIQNRRSLEAIVQQRPRSCPDCTPRVLCNFHTFVPSSKEMVALSDNIPAGVTHKNQDIEEKIIEEQSLLSTYELPSCYPTKDLTSIYDIKPFPKITDTKKTEDLYWRQQSLKTQPTPYCKPDHWIHYENLKSPLRDQYNMCPDPVSLSKPSVLQNKQDTEAFTLEHFLSKPEEELFLNMENNEETRPVLGWIPRAGVTKPQTNLLELKNSFSKTGAQKRFHKSILEDHKDLRDNEHSGMKHQFYGHNSYYFYN

SEQ ID NO: 10793 - protein, 590 aa, Homo sapiens; identical to SEQ ID NO: 10792

SEQ ID NO: 10794 - protein, 115 aa, Homo sapiens
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLT

SEQ ID NO: 10795 - protein, 153 aa, Homo sapiens
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLTQNKKSDVYGNDSLIPKPPNSTVGEICLPYPIEHPYHTH

SEQ ID NO: 10796 - protein, 92 aa, Homo sapiens
MEVIHGRPYCCRELEGADILSNTFYSNELHNPLQTVTRPTASEDRYQELRESLQQCRLPWGAEREYGGIIPISLPEDHRPKYEPPRVMGKGH

SEQ ID NO: 10797 - protein, 177 aa, Homo sapiens
MQVEVQSLSLEECPWRLPGPQCECEALLPSGARRRIDLRLSGRAVAVWVHVRGGPGQFNLSYATGRHKKPNPHQNMNRGMEFIAPVSAPTKSGAPWHFLSQGPTDAQRAVRIRPGTRMGLSSDPVVGTLSSSYLDLLTLSYKPGRTVTSSYLNVRGHEVRKLQNSVEATRISRTDSS

SEQ ID NO: 10798 - protein, 131 aa, Homo sapiens
MDFQQLADVAEKWCSNTPFELIATEETERRMDFYADPGVSFYVLCPDNGCGDNFHVWSESEDCLPFLQLAQDYISSCGKKTLHEVLEKVFKSFRPLLGLPDADDDAFEEYSADVEEEEPEADHPQMGVSQQ

SEQ ID NO: 10799 - protein, 98 aa, Homo sapiens
MATHCPLYCVGADLMMNRAGEHVWSESEDCLPFLQLAQDYISSCGKKTLHEVLEKVFKSFRPLLGLPDADDDAFEEYSADVEEEEPEADHPQMGVSQQ

SEQ ID NO: 10800 - protein, 131 aa, Homo sapiens; identical to SEQ ID NO: 10798

SEQ ID NO: 10801 - protein, 98 aa, Homo sapiens; identical to SEQ ID NO: 10799

SEQ ID NO: 10802 - protein, 199 aa, Homo sapiens
MHKKSGFENQMRLCWRRPCGNEERCSVCWSLFLPPGKQLCEEERRAMQAALDSVVCHTPLNNLGFSRKGSALTFSVAFQALRTGLFEHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 10803 - protein, 580 aa, Homo sapiens
MESQCDYSMYFPAVPLPPRAELAGDPGRYRALPRRNHLYLGETVRFLLVLRCRGGAGSGTGGGPGLGSRGAWAELATALAALASVSAGGGMPGGGGAGDQDSEPPGGGDPGGGGLFRGCSPLLTHGPGPATSGGATTLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 10804 - protein, 298 aa, Homo sapiens
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIGVPSVEFLESPITAVDSPFLKAFQASSSSSPETLTDVGTSSQVSSLRRPEEDDMAFFERRYQERMKMEKAAKWKGKAPLPSATKPS

SEQ ID NO: 10805 - protein, 262 aa, Homo sapiens
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIVGTSSQVSSLRRPEEDDMAFFERRYQERMKMEKAAKWKGKAPLPSATKPS

SEQ ID NO: 10806 - protein, 204 aa, Homo sapiens
MERLTLPLGGAAAVDEYLEYRRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIVGTSSQVSSLRRPEEDDMAFFERRYQERMKMEKAAKWKGKAPLPSATKPS

SEQ ID NO: 10807 - protein, 194 aa, Homo sapiens
MAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 10808 - protein, 194 aa, Homo sapiens; identical to SEQ ID NO: 10807

SEQ ID NO: 10809 - protein, 194 aa, Homo sapiens; identical to SEQ ID NO: 10807

SEQ ID NO: 10810 - protein, 192 aa, Homo sapiens
MAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQL

SEQ ID NO: 10811 - protein, 295 aa, Homo sapiens
MRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVPGQKNSSPTNFSKLISNGYKDEWLQQQQRADSDKRTPKTSRASVLSQSPRDLEGPQDAARLQDAEASEGPEDTPESSQSPEESVSASTPAELK

SEQ ID NO: 10812 - protein, 295 aa, Homo sapiens
MRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVPGQKNSSPTNFSKLISNGYKDEWLQQQQRADSDKRTPKTSRASVLSQSPRDLEGPQDAARLQDAEASEGPEDTPESNTCPEESVSASTPAELK

SEQ ID NO: 10813 - protein, 153 aa, Homo sapiens
MPDYMVHEEFNPDQANGSYASRRGPFDFDMKTVWQREAEELEKEKKKLRLPAIDSKYLSKAGTPLGPKNPAGSRLSFPPVNGYKDEWLQQQQRADSDKRTPKTSRASVLSQSPRDLEGPQDAARLQDAEASEGPEDTPGPEESVSASTPAELK

SEQ ID NO: 10814 - protein, 99 aa, Homo sapiens
MTSALTQGLERIPDQLGYLVLSEGAVLASSGDLENDEQAASAISELVSTACGFRLHRGMNVPFKRLSVVFGEHTLLVTVSGQRVFVVKRQNRGREPIDV

SEQ ID NO: 10815 - protein, 405 aa, Homo sapiens
MEPGAGGRNTARAQRAGSPNTPPPREQERKLEQEKLSGVVKSVHRRLRKKYREVGDFDKIWREHCEDEETLCEYAVAMKNLADNHWAKTCEGEGRIEWCCSVCREYFQNGGKRKALEKDEKRAVLATKTTPALNMHESSQLEGHLTNLSFTNPEFITELLQASGKIRLLDVGSCFNPFLKFEEFLTVGIDIVPAVESVYKCDFLNLQLQQPLQLAQDAIDAFLKQLKNPIDSLPGELFHVVVFSLLLSYFPSPYQRWICCKKAHELLVLNGLLLIITPDSSHQNRHAMMMKSWKIAIESLGFKRFKYSKFSHMHLMAFRKISLKTTSDLVSRNYPGMLYIPQDFNSIEDEEYSNPSCYVRSDIEDEQLAYGFTELPDAPYDSDSGESQASSIPFYELEDPILLLS

SEQ ID NO: 10816 - protein, 352 aa, Homo sapiens
MGDFDKIWREHCEDEETLCEYAVAMKNLADNHWAKTCEGEGRIEWCCSVCREYFQNGGKRKALEKDEKRAVLATKTTPALNMHESSQLEGHLTNLSFTNPEFITELLQASGKIRLLDVGSCFNPFLKFEEFLTVGIDIVPAVESVYKCDFLNLQLQQPLQLAQDAIDAFLKQLKNPIDSLPGELFHVVVFSLLLSYFPSPYQRWICCKKAHELLVLNGLLLIITPDSSHQNRHAMMMKSWKIAIESLGFKRFKYSKFSHMHLMAFRKISLKTTSDLVSRNYPGMLYIPQDFNSIEDEEYSNPSCYVRSDIEDEQLAYGFTELPDAPYDSDSGESQASSIPFYELEDPILLLS

SEQ ID NO: 10817 - protein, 206 aa, Homo sapiens
MVVVMKFFRWVRRAWQRIISWVFFWRQKIKPTISGHPDSKKHSLKKMEKTLQVVETLRLVELPKEAKPKLGESPELADPCVLAKTTEETEVELGQQGQSLLQLPRTAVKSVSTLMVSALQSGWQMCSWKSSVSSASVSSQVRTQSPLKTPEAELLWEVYLVLWAVRKHLRRLYRRQERHRRHHVRCHAAPRPNPAQSLKLDAQSPL

SEQ ID NO: 10818 - protein, 253 aa, Homo sapiens
MSFSVHNQKGSKRPLPLEPLLFLQVPRSNYLHFQEEKQRLHLKKFLLDRMFLVAKIQANVERKDVADYYEQMFQSVLKHHLGEAVTGLLLIYPTSILHILESSSDTLYKVLLDYIGHVKDETVFFIQQMKIIVISHNIPMRLFMQWHVSVIKVPVMYLDDVTQSQSLKEVITDFLTQTHKLSLYLCQTMKVGTKGPGDNLHQVAPDLLLPEQIIKYLCKSEEFMDPATFINMYNRPIHITLDSEVVWPAPSRF

SEQ ID NO: 10819 - protein, 895 aa, Homo sapiens
MWTEEAGATAEAQESGIRNKSSSSSQIPVVGVVTEDDEAQDVFKPMDLNRVIKLLEETDKDGLEEKQLKFVKKLVQCYQNGLPLRDLAQIFKILNLCSGKIKNQPRFIESAYDIIKLCGLPFLKKKVSDEITYAEDTANSIALLGDLMKIPSSELRIQICKCIVDFYHAEPPKKHIPGYQQASSSYKIQMAEVGGLAKTMVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAVVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKSLQEKAIEASRYHKRPQNAIFHQTHIKGLNTTVPSGGVVTVESTPARLVGGPLVDTDIALKKLPIRGGALQRVKAVKIVDAPKKSIPT

SEQ ID NO: 10820 - protein, 941 aa, Homo sapiens
MWTEEAGATAEAQESGIRNKSSSSSQIPVVGVVTEDDEAQDVFKPMDLNRVIKLLEETDKDGLEEKQLKFVKKLVQCYQNGLPLRDLAQIFKILNLCSGKIKNQPRFIESAYDIIKLCGLPFLKKKVSDEITYAEDTANSIALLGDLMKIPSSELRIQICKCIVDFYHAEPPKKHIPGYQQASSSYKIQMAEVGGLAKTMVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAVVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDTKKPLFTSFQEEQKIIPLPANCPSIAVMDVSENIRAKIYAILGKLDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKSLQEKAIEASRYHKRPQNAIFHQTHIKGLNTTVPSGGVVTVESTPARLVGGPLVDTDIALKKLPIRGGALQRVKAVKIVDAPKKSIPT

SEQ ID NO: 10821 - protein, 478 aa, Homo sapiens
ELQLHAIATLSSVAPLLIEEYMSCQGNARVLAFLEWCESEDPFFSHGNSFHGTGGRGNKFAQMRYSLRLLRAVVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKSLQEKAIEASRYHKRPQNAIFHQTHIKGLNTTVPSGGVVTVESTPARLVGGPLVDTDIALKKLPIRGGALQRVKAVKIVDAPKKSIPT

SEQ ID NO: 10822 - protein, 923 aa, Homo sapiens
MWTEEAGATAEAQESGIRNKSSSSSQIPVVGVVTEDDEAQDVFKPMDLNRVIKLLEETDKDGLEEKQLKFVKKLVQCYQNGLPLRDLAQIFKILNLCSGKIKNQPRFIESAYDIIKLCGLPFLKKKVSDEITYAEDTANSIALLGDLMKIPSSELRIQICYQQASSSYKIQMAEVGGLAKTMVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAVVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDTKKPLFTSFQEEQKIIPLPANCPSIAVMDVSENIRAKIYAILGKLDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKSLQEKAIEASRYHKRPQNAIFHQTHIKGLNTTVPSGGVVTVESTPARLVGGPLVDTDIALKKLPIRGGALQRVKAVKIVDAPKKSIPT

SEQ ID NO: 10823 - protein, 151 aa, Homo sapiens
MRMAPTESTEGRRLWPGPREGGSGKETTSEKLSNLPRPHSYSPKRADAESFRGVPAAFKKCREVFRACWGSRELLFLFKAISEAGPAQNSCGITLEKAGGLEDTGSHWLSWARCKVLYINGFTDPWKDAQAWILIVSCKKGKGTPEREGRN

SEQ ID NO: 10824 - protein, 169 aa, Homo sapiens
MGSCGWALTQSDWCPFKKRKRHQRCAHSETRHMRTQRQGGYLQARERGLGEANPAYALILDFQPPELQNLSEMGINHELGYSSIIPMMKRAFSACGTLGLIMSGIFDNPGPIKNTLKKAFTMLWSFTVYTRLESLRVALSNEEMVPFIFHLKTQTANMLSGPISTPMLL

SEQ ID NO: 10825 - protein, 438 aa, Homo sapiens
MDVEIQDTPGKISISKRSILSGTVENIDYPHYCDLLRKMNMPFVKGLENRHNYGRFEKKCNPAFLKFHPYPPSVLPDYHLHDPYPPPYGPHYPLFPLRDDVTLGDSCSGFMSPGGDADLNPGIGRTIPTLVDFSDVKPQHRVPRPDTGFQTTIKRQKILSEELQQNRRWNSREVPDISIRARLGGWTSPLKVTPLQPHHEGRSLSHIFTFDEEATCTDEGEPLVQTNKKCNAKDSFYKSSTQKAYEDVPWDKMLPPKLVPEETTLEKTADPISQCFTLKRYKGVPAITQMVGELWDRFQTRSFLAPVKPINFVSSSSRSKYIPLYTGHVQSTNADDVDNPLGDIASLAKQRYSKPLYTNTSRAANIPGYTGKVHFTATHPANSNIPSTTPSPDSELHRVFQKEMAVDLFRHQAPLSRLVTTVRPYNPFNKKDKETIDY

SEQ ID NO: 10826 - protein, 47 aa, Homo sapiens
MLQFLLGFTLGNVVGMYLAQNYDIPNLAKKLEEIKKDLDAKKKPPSA

SEQ ID NO: 10827 - protein, 104 aa, Homo sapiens
MGRSPCFFKSFKGKLHKDRSPDPSTLASPHPSTEARRPVEAGSAEWTWGWMKRLPPASLSPGIAMSCYSGDSMLQKYKVKNAYRLHWQGREEPGASTFASLVFQ

SEQ ID NO: 10828 - protein, 104 aa, Homo sapiens; identical to SEQ ID NO: 10827

SEQ ID NO: 10829 - protein, 84 aa, Homo sapiens
MASVPSIGCLLARNQYYRKSSVSSVSSLTSSDSVNFIDDDKPQQGLPEVAESTWWFKSFFHSEPVLSNVRIKDLSATGSLSGRS

SEQ ID NO: 10830 - protein, 81 aa, Homo sapiens
MASVPSIGCLLARNQYYRKSSVSSVSSLTSSDSVNFIDDDKPQQGLPEVAESTWWFKSFFHSEPVLSNVRIKDLSATGMNS

SEQ ID NO: 10831 - protein, 132 aa, Homo sapiens
MAEKPHQNSCNSVRQLFKTKQLVTHRDRGSCTHRAQGLLAARTTALQRSPLQQEIWESTTALNLPSALAPQGLTAKDAHFLGDTDPIQEGARDHAAGGPFQDRQASVAAQTLSWERGQGFSRHHGNHLLYSH

SEQ ID NO: 10832 - protein, 229 aa, Homo sapiens
MAALGHLAGEAAAAPGPGTPCASRGARLPGPVSSARNPSTVCLCPEQPTCSNADSRAHPLGDEGGTASKKQKNKKKTRNRASVANGGEKASEKLAPEEVPLSAEAQAQQLAQELAWCVEQLELGLKRQKPTPKQKEQAIGAIRTLRSKRTPLPRKRQLMHSLFGDYRAQMEAEWREALRALRAAAYSAQVQPVDGATRKKSQRVCRPRSIWRAKATLDMPDEEFRFNFF

SEQ ID NO: 10833 - protein, 201 aa, Homo sapiens
MENGFTMCQTGRQHPVACGLHLSGGKEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKHLLNQNLCGWDSEFCIFHTLASFLIYK

SEQ ID NO: 10834 - protein, 427 aa, Homo sapiens
MTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 10835 - protein, 287 aa, Homo sapiens
MASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLGNFKN

SEQ ID NO: 10836 - protein, 538 aa, Homo sapiens
MSSPLASELSELAALRPGFRLSAPHARVAPRAATHARGRGRASHAGQPRLRSSCPGPSPGKRRVVPSGGAQPRVLPALSSRSHLFPMASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 10837 - protein, 129 aa, Homo sapiens
MASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSCKEVSYSNAIQSM

SEQ ID NO: 10838 - protein, 452 aa, Homo sapiens
MASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 10839 - protein, 207 aa, Homo sapiens
MAEDLDELLDEVESKFCTPDLLRRGMVEQPKGCGGGTHSSDRNQAKAKETLRSTETFKKEDDLDSLINEILEEPNLDKKPSKLKSKSSGNTSVRASIEGLGKSCSPVYLGGSSIPCGIGTNISWRACDHLRCIACDFLVVSYDDYMWDKSCDYLFFRNNMPEFHKLKAKLIKKKGTRAYACQCSWRTIEEVTDLQTDHQLRWVCGKH

SEQ ID NO: 10840 - protein, 102 aa, Homo sapiens
MAQDFSQHPQTGIIRRHRFYSPKPLSTTPRGQSFLLSRQAKVATWDPMLSPDFQPKSAFKLTWTAQPPCLSVTPSQGQTFHPNSPEGELPPDLTENTCPSQA

SEQ ID NO: 10841 - protein, 185 aa, Homo sapiens
MWKLGRGRVLLDEPPEEEDGLRGGPPPAAAAAAQAQVQGASFRGWKEVTSLFNKDDEQHLLERCKSPKSKGTNLRLKEELKAEKKSGFWDNLVLKQNIQSKKPDEIEGWEPPKLALEDISADPEDTVGGHPSWSGWEDDAKGSTKYTSLASSANSSRWSLRAAGRLVSIRRQSKGHLTDSPEEAE

SEQ ID NO: 10842 - protein, 198 aa, Homo sapiens
MWKLGRGRVLLDEPPEEEDGLRGGPPPAAAAAAQAQVQGASFRGWKEVTSLFNKDDEQHLLERCKSPKSKGTNLRLKEELKAEKKSGFWDNLVLKQNIQSKKPDEIEGWEPPKLALEDISADPEDTVGGHPSWSGWEDDAKGSTKYTSLASSANSSRWSLRAAGRLIKEVWINFSQLIISFRKHCLAHYRELRLCIKY

SEQ ID NO: 10843 - protein, 198 aa, Homo sapiens; identical to SEQ ID NO: 10842

SEQ ID NO: 10844 - protein, 159 aa, Homo sapiens
MRKNESYLNQPAPPIPIPTLSLMGGCREHFENHWKGRARWLMPVIPALWEAKAGRSPEVRSSKPAWPTWRNPIFTKNTKISQVLELFLNYQSLICALEKQKRQKGSLAIFCWSFQGGCVSKRPDVPSLKSQKPKRKRITGRKRLSKGFWSLLFSNLGRF

SEQ ID NO: 10845 - protein, 159 aa, Homo sapiens; identical to SEQ ID NO: 10844

SEQ ID NO: 10846 - protein, 632 aa, Homo sapiens
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPVQCSFWSFVDVDSSSRRNAQKINTLIGQMDCSLIPANLVEAFGLLINCNESSPCHPFLPTVQHTLNKAINPEGLFYAASRQFTTEDFEKLLAFAKNLNVEFSLEAERMTHGYYLASRRIRTGSVCGSKLSASALKYLVFLSEAHARLNLRNKVLKEDVLIAALLFETSLTLKYGNELNY

SEQ ID NO: 10847 - protein, 333 aa, Homo sapiens
MMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPSVQFLVFC

SEQ ID NO: 10848 - protein, 590 aa, Homo sapiens
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPVQCSFWSFVDVDSSSRRNAQKINTLIGQMDCSLIPANLVEAFGLLINCNESSPCHPFLPTVQHTLNKAINPEGLFYAASRQFTTEDFEKLLAFAKNLNVEFSLEAERMTHGYYLASRRIRTGSVCGSKLSASALKYL

SEQ ID NO: 10849 - protein, 681 aa, Homo sapiens
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPVQCSFWSFVDVDSSSRRNAQKINTLIGQMDCSLIPANLVEAFGLLINCNESSPCHPFLPTVQHTLNKAINPEGLFYAASRQFTTEDFEKLLAFAKNLNVEFSLEAERMTHGYYLASRRIRTGSVCGSKLSASALKYLVFLSEAHARLNLRNKVLKEDVLIAALLFETSLTLKYGATVFCVAPNAVFPFELYNEEYLEQRDLYLTQCQQQLEQFIATYGPGTTIFSSDE

SEQ ID NO: 10850 - protein, 618 aa, Homo sapiens
MIASTTMVRSAKVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPVQCSFWSFVDVDSSSRRNAQKINTLIGQMDCSLIPANLVEAFGLLINCNESSPCHPFLPTVQHTLNKAINPEGLFYAASRQFTTEDFEKLLAFAKNLNVEFSLEAERMTHGYYLASRRIRTGSVCGSKLSASALKYLVFLSEAHARLNLRNKVLKEDVLIAALLFETSLTLKYGATVFCVAPNAVFPFELYNEEYLEQRDLYLTQCQQQLEQFIATYGPGTTIFSSDE

SEQ ID NO: 10851 - protein, 207 aa, Homo sapiens
MMHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIPPVPRISVKTSASASLEATAMGTEKGAVLMRGSRHLKKMTEEYPALPQGAEASLPLTGSASCGVPGILRKMWTRHKKKSEYVGATNSAFEAD

SEQ ID NO: 10852 - protein, 374 aa, Homo sapiens
MGCSSSALNKAGDSSRFPSVTSNEHFSTAEESESCFAQPKPHALGRESTVDGNVQRESRPPLQKLKVSAEPTANGVKPLQEQPLAKDVAPGRDATDQSGSTEKTQPGEGLEESGPPQPGGKEDAPAAEGKKKDAGAGTEAESLKGNAEAQPLGPEAKGQPLQAAVEKDSLRAVEVTENPQTAAEMKPLGTTENVLTLQIAGELQPQGTVGKDEQAPLLETISKENESPEILEGSQFVETAEEQQLQATLGKEEQPQLLERIPKENVTPEVLDRSQLVEKPVMNDPFHKTPEGPGNMEQIQPEGIVGSMEHPARNVEAGAYVEMIRNIHTNEEDQRIEGETGEKVETDMENEKVSEGAETKEEETGEVVDLSAAT

SEQ ID NO: 10853 - protein, 56 aa, Homo sapiens
MGCSSSALNKAGDSSRFPSGETGEKVETDMENEKVSEGAETKEEETGEVVDLSAAT

SEQ ID NO: 10854 - protein, 319 aa, Homo sapiens
MAICPELAQTDKSALANLSDETETLKNSTDEVQTSSSFSSSGGRQSSPLTSGSKLEREKQTPSLEQGDTQSELLDYKNYEKKLSKKWINYLKLKDSNFERHQPDTKLPTEITRVSDEELNALQSYCTMKINLIHRRGDSKKKTSSRHKKLHLGLDVEASERDAFSCTVPDELLNRIYFKNMRTTPKQEAAAKQHISYQCPYCNRKRAELALSAFLKQKKTLLESFLLQERIDEHLHTKDFLTRIGEAHQDFPRLSDDPRIIWKRLTEKSHIRYSGFERSETEQKLQRDGNSACHLPFSLPFLKRLTLIKPELVIVNDNV

SEQ ID NO: 10855 - protein, 230 aa, Homo sapiens
MEKPRLYQKYKISRVWWRLPVIPATGEAEDNRLNPEGRGCGEPRSRHCTPAWTTTAKLHLKTIISLQPLNMYQMEPGVGSIRTSPALQSPPALTRGPSAWDTAIRKALSFGVGLGVLVLVCLFYHFVTLAPILQFASLPCLLEAGAQMSRHPVTTQVCVMPARLSLGSGISRNLLRLSVCHFTLLLPFRSLRPCPLSSRDMVLSYELWLLCDFYIAPPDSSGSGICKKAI

SEQ ID NO: 10856 - protein, 105 aa, Homo sapiens
MSLKSWHPQSKTKRVGASEGNPQWGSGSMEAPLLSSFLPPLASEAELTGNTWFLHRCSCILNLEESMDSDWGAWWGVSLPRRAPFLIYGSDGPWCTQAGFPGWGH

SEQ ID NO: 10857 - protein, 105 aa, Homo sapiens; identical to SEQ ID NO: 10856

SEQ ID NO: 10858 - protein, 365 aa, Homo sapiens
MMGRRRAFAVDGRDGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKRDISHWDKVKVLLNRICRRSHHHPEPPAPPDGSDPRIESRDLPERPQCRPHRKTFMPSLVVKKQRAKNLSVG

SEQ ID NO: 10859 - protein, 328 aa, Homo sapiens
MAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKRDISHWDKVKVLLNRICRRSHHHPEPPAPPDGSDPRIESRDLPERPQCRPHRKTFMPSLVVKKQRKKPFCRLRPLGAPGDPGWRGLAVKSSSPSALLLLLHIARKSC

SEQ ID NO: 10860 - protein, 357 aa, Homo sapiens
MMGRRRAFAVDGRDGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKVKVLLNRICRRSHHHPEPPAPPDGSDPRIESRDLPERPQCRPHRKTFMPSLVVKKQRAKNLSVG

SEQ ID NO: 10861 - protein, 43 aa, Homo sapiens
MAKNKLRGPKSRNVFHIASQKNFKAKNKAKPVTTNLKKVLHFS

SEQ ID NO: 10862 - protein, 98 aa, Homo sapiens [sequence omitted]

SEQ ID NO: 10863 - protein, 98 aa, Homo sapiens [sequence omitted]

SEQ ID NO: 10864 - protein, 98 aa, Homo sapiens [sequence omitted]

SEQ ID NO: 10865 - protein, 98 aa, Homo sapiens [sequence omitted]

SEQ ID NO: 10866 - protein, 45 aa, Homo sapiens
MAKNKLRGPKSRNVFHIASQKNFKAKNKAKPVTTNLKKINIMNEE

SEQ ID NO: 10867 - protein, 98 aa, Homo sapiens [sequence omitted]

SEQ ID NO: 10868 - protein, 43 aa, Homo sapiens; identical to SEQ ID NO: 10861

SEQ ID NO: 10869 - protein, 719 aa, Homo sapiens
MAGGVWGRSRAREAPVGALTLTALTEGIRARQGQPQGPPSAGPQPKSWEVKPEAEPQTQALTAPSEAEPGRGATVPEAGSEPCSLNSALEPAPEGPHQVPQSSWEEGVLADLALYTAACLEEAGFAGTQATVLTLSSALEARGERLEDQVHALVRGLLAQVPSLAEGRPWRAALRVLSALALEHARDVVCALLPRSLPADRVAAELWRSLSRNQRVNGQVLVQLLWALKGASGPEPQALAATRALGEMLAVSGCVGATRGFYPHLLLALVTQLHKLARSPCSPDMPKIWVLSHRGPPHSHASCAVEALKALLTGDGGRMVVTCMEQAGGWRRLVGAHTHLEGVLLLASAMVAHADHHLRGLFADLLPRLRSADDPQRLTAMAFFTGLLQSRPTARLLREEVILERLLTWQGDPEPTVRWLGLLGLGHLALNRRKVRHVSTLLPALLGALGEGDARLVGAALGALRRLLLRPRAPVRLLSAELGPRLPPLLDDTRDSIRASAVGLLGTLVRRGRGGLRLGLRGPLRKLVLQSLVPLLLRLHDPSRDAAESSEWTLARCDHAFCWGLLEELVTVAHYDSPEALSHLCCRLVQRYPGHVPNFLSQTQGYLRSPQDPLRRAAAVLIGFLVHHASPGCVNQDLLDSLFQDLGRLQSDPKPAVAAAAHVSAQQVAMLARARGCPRGPRLLRIAPRPARPPPVFADSPFQRRSVAGRWGCSGPRRA

SEQ ID NO: 10870 - protein, 294 aa, Homo sapiens
MALLTPQGVKEVFQLQRPQGRERLRRLLNWEEFDEQRDSRRSILLDTLYESIIFAVGKGFPWVEVAQVVKFTEELLRETKGCSITEAVTILGNKLRDYRGHFNTTHLLALCDYFHHTFIRHYKLYQYVLGQDQQVDLTVAHLEVCMPPHPLPLAEGMDRDLWIHEQQVATLTEAEAQKRADVLLLKEALRLERENSLQKAFAAAAPAQPGQVLERQELESLICQAVHTQMELLQELLQRQIQNTFAILDLKLQKKTLNLNAPTPIPPPITSHAGQEEALKPQRASKGKKAKARK

SEQ ID NO: 10871 - protein, 380 aa, Homo sapiens
MDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVMGEDIPEKIKDEVHPEVKCVGSVALTALVTVSSEEFEDKWFRKIKDHFCPFENQFHTEIQILA

SEQ ID NO: 10872 - protein, 211 aa, Homo sapiens
MLRQSCSFPVTSLPALGGVCGREGAGAEVPPAACGCEGRDPDTERSCGRSSTGGCSPCSGPGPSSPRTSRGALSPSLGRLFPHLQVVIKLRIQLAPAVHLALPTCSLLTSSPPLEGCCHRLNEEAEVQRGFRPIAVELEFENQPLGAETRLRNGRRAGVKRSEGRGQVRPGQVRSTGPEGGLTRMERKAARLQWDSGSIKMSENEQLWEEP

SEQ ID NO: 10873 - protein, 86 aa, Homo sapiens
MWPPCGTLRTLALARSRGARACSGDGGVSYTQGQSPEPRTREYFYYVDHQGQLFLDDSKMKNFITCFKGNAVPPSPAPSFSLPGSP

SEQ ID NO: 10874 - protein, 155 aa, Homo sapiens
MGPGDFRRCRERISQGLQGLPGRAELWFPPRPACDFFGDGRSTDIQEEALAASPLLEDLRRRLTRAFQWAVQRAISRRVQEAAAAAAAREEQSWTGVEATLARLRAELVEMHFQNHQLARTLLDLNMKVQQLKKEYELEITSDSQSPKDDAANPE

SEQ ID NO: 10875 - protein, 223 aa, Homo sapiens
MRPLGKGLLPAEELIRSNLGVGRSLRDCLSQSGKLAEELGSKRLKPAKFGTEGKERVEQRTERQRTGSSKEPRMQIICRRRWREPPPRLLWGCLMPRAQPLLHVTAYENTGHWERLASVVSSKTQQPTVISHSSISITFSHYPPATLDSFLVLEPIKLFPVSSLRSPLCLNCGSCRESIRISGELIGNAHSPAPPRTPELETLGWDKQAVLSGAQVILVCAEV

SEQ ID NO: 10876 - protein, 101 aa, Homo sapiens
MRTPKRTRSPKTKVSLRGETLTLQLTTVSLDTRHMVKRCDERHGRPLPHSQESQHGSATSKKAVRGTADTAPLERISAARGWALPMEATVSVFRAHQWQWN

SEQ ID NO: 10877 - protein, 186 aa, Homo sapiens
MELSCPGSRCPVQEQRARWERKRACTARELLETERRYQEQLGLVATYFLGILKAKGTLRPPERQALFGSWELIYGASQELLPYLEGGCWGQGLEGFCRHLELYNQFAANSERSQTTLQEQLKKNKGFRRFVRLQEGRPEFGGLQLQDLLPLPLQRLQQYENLVVALAENTGPNSPDHQQLTPVLPS

SEQ ID NO: 10878 - protein, 335 aa, Homo sapiens
MELSCPGSRCPVQEQRARWERKRACTARELLETERRYQEQLGLVATYFLGILKAKGTLRPPERQALFGSWELIYGASQELLPYLEGGCWGQGLEGFCRHLELYNQFAANSERSQTTLQEQLKKNKGFRRFVRLQEGRPEFGGLQLQDLLPLPLQRLQQYENLVVALAENTGPNSPDHQQLTRAARLISETAQRVHTIGQKQKNDQHLRRVQALLSGRQAKGLTSGRWFLRQGWLLVVPPHGEPRPRMFFLFTDVLLMAKPRPPLHLLRSGTFACKALYPMAQCHLSRVFGHSGGPCGGLLSLSFPHEKLLLMSTDQEELSRWYHSLTWAISSQKN

SEQ ID NO: 10879 - protein, 299 aa, Homo sapiens
MLGVCQTLKQYFLGILKAKGTLRPPERQALFGSWELIYGASQELLPYLEGGCWGQGLEGFCRHLELYNQFAANSERSQTTLQEQLKKNKGFRRFVRLQEGRPEFGGLQLQDLLPLPLQRLQQYENLVVALAENTGPNSPDHQQLTRAARLISETAQRVHTIGQKQKNDQHLRRVQALLSGRQAKGLTSGRWFLRQGWLLVVPPHGEPRPRMFFLFTDVLLMAKPRPPLHLLRSGTFACKALYPMAQCHLSRVFGHSGGPCGGLLSLSFPHEKLLLMSTDQEELSRWYHSLTWAISSQKN

SEQ ID NO: 10880 - protein, 56 aa, Homo sapiens
MRRPWEKKEATRNPIAEVLARKKRTEELISLQEHGSRKQKIKEASISWAETSRQIG

SEQ ID NO: 10881 - protein, 73 aa, Homo sapiens
MQFADWLHPSGWTIEILNAYGMGDRKRTNSMSKEAFTPEQLHLEKELGEMRLRPTVLHSQTDHQGFRPIPMMQ

SEQ ID NO: 10882 - protein, 376 aa, Homo sapiens
MAERGRKRPCGPGEHGQRIEWRKWKQQKKEEKKKWKDLKLMKKLERQRAQEEQAKRLEEEEAAAEKEDRGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEEAILISLAALQPGLIQAGARHT

SEQ ID NO: 10883 - protein, 388 aa, Homo sapiens
MAERGRKRPCGPGEHGQRIEWRKWKQQKKEEKKKWKDLKLMKKLERQRAQEEQAKRLEEEEAAAEKEDRGRPYTLSVALPGSILTMLSRRSFAPTWPVRLPEPVPSSVWMRSWCLMRRARMPRLWRGNSQELEEGAGVRTAGPDPAVPECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASASFPTSGMLLWCSGASRVWKLERMLTPTWRWLNPVSSLTCTSIPVLARVAVPSARRKPSSSPWPPCSLASSRRVPGTPESSKGPRTSVKQQ

SEQ ID NO: 10884 - protein, 92 aa, Homo sapiens
MAEECPRACAEPVAPKATAPPERTSDYYRVSADLPGRFNNPGWFRGYRTQKAVSVYRTSNQAYGSRAPTVHEMPRVECSGTILSMFTWRKAS

SEQ ID NO: 10885 - protein, 92 aa, Homo sapiens; identical to SEQ ID NO: 10884

SEQ ID NO: 10886 - protein, 136 aa, Homo sapiens
MAEECPRACAEPVAPKATAPPERTSDYYRVSADLPGRFNNPGWFRGYRTQKAVSVYRTSNQAYGSRAPTVHEMPKVFYPNSNKFSQQLAAGGMFRNNTLNVYLEKSIVTGPDNCITSCDRLNFHPSYNINRPSICD

SEQ ID NO: 10887 - protein, 126 aa, Homo sapiens
MGTEVGISWTRVGTGATVGLLPPHPHQQMHRDEEDSDVDVTFQPWHKEMLQQLLVMLSSTVATRPQKAACPHQESQSHGPPKESVPWAPTQRSGNAEQRCSGEGARRRGPETRPLRTPEGWAGRAP

SEQ ID NO: 10888 - protein, 520 aa, Homo sapiens
MAPKKSVSKAGKELEVKKKGGKKEPVVAVEPPLAKEMKEFYHIQIRDLEDRLARYQRKWDELAVQEKMFRQEFEQLANNKKEIVAFLKRTLNQQVDEITDLNEQLQNLQLAKEMEKDAFEAQLAQVRHEFQETKDQLTTENIILGGKLAALEEFRLQKEEVTDKFTLLEEQVRKQENEFRDYAYNLEKKSVLDKDRLRKEIIQRVNLVANEFHKVTTNRMWETTKRAIKENNGITLQMARVSQQGMKLLQENEQLKGRQNNLCKQLELLENTQKVMARHKRGHQKIILMLTKKCQEQQQDTKEAEELRLLLSQLEQRSLQLQVDNQALKSQRDQLSLQLEQQQVDLQRLQQELANEQKVRASLEAALVQATSFLQNILQMHRDEEDSDVDVTFQPWHKEMLQQLLVMLSSTVATRPQKAACPHQESQSHGPPKESRPSIQLPRTGSLLPQLSDITPYQPGDLGLVPRQVHIPPNPQDLRLLSYITRVGTFRAHSSPEMRAPGSLKRLEKFSLPEVPLRPK

SEQ ID NO: 10889 - protein, 69 aa, Homo sapiens
MCYVVPGCFIYICGCTRIKSTHFNGKSQMVDLKSQSWDLERLENKPPPAVYDLAATTSQLGEWAKSRIW

SEQ ID NO: 10890 - protein, 301 aa, Homo sapiens
MEAHEIIEEPHITMDAEKHPPSKDPSAEDLQENHISESFLKPSTSETPLEPHTSESPLVPSPSQIPLEAHSPETHQEPSISETPSETPTYEASLDSPISVVPEKHLTLPPQSRDYVCLSSSDTLKEDLSSESSSNEVPWTRRSTHLSESESLPEHCLSGPSSQVQVDTTEKQEEEAGEVEKGVDASDSTAHTAQPGHQLGNTARPVFPARQTELVEVAKAMHREEFGAQVNNLFQWEKDAALNAIQTGLYIGWRCPHYLWDCFRIGDESRCFCGHLLREHRIISDISVPCKVSQCRCFMFC

SEQ ID NO: 10891 - protein, 402 aa, Homo sapiens
MEAHEIIEEPHITMDAEKHPPSKDPSAEDLQENHISESFLKPSTSETPLEPHTSESPLVPSPSQIPLEAHSPETHQEPSISETPSETPTYEASLDSPISVVPEKHLTLPPQSRDYVCLSSSDTLKEDLSSESSSNEVPWTRRSTHLSESESLPEHCLSGPSSQVQVDTTEKQEEEAGEVEKGVDASDSTAHTAQPGHQLGNTARPVFPARQTELVEVAKAMHREEFGAQVNNLFQWEKDAALNAIQTGLYIGWRCPHYLWDCFRIGDESRCFCGHLLREHRIISDISVPCKVSQCRCFMFCFIPSRPEEVGEFWLKRRATFDPKAWRAQCRCKHSHEEHAATGPHPCRHHGCCCGCFESNFLCAACDRRWEEHETFFDTQKTRQRGGRPRGTDTVSNWHRPL

SEQ ID NO: 10892 - protein, 90 aa, Homo sapiens
MEAHEIIEEPHITMDAEKHPPSKDPSAEDLQENHISESFLKPSTSETPLEPHTSESPLVPSPSQIPLEAHSPETHQEPSISETPSETPTY

SEQ ID NO: 10893 - protein, 196 aa, Homo sapiens
MPGMVPPHVPPQMLNIPQTSLQAKPVAPQVPSPGGAPGQGPYPYSLSEPAPLTLDTSGKNLTEQNSYSNIPHEGKHTPLYERSLPINPAQSGSPNHVDSAYFPGSSTSSSSDNDEGSGGATKYTIYWGFRATDHHVQGRDSQARGTAAHWHGGHVCSPNVFWRISHGPAQQLTFPTEQAAPPVCPAPASRRLSAPG

SEQ ID NO: 10894 - protein, 1079 aa, Homo sapiens
MEWLLEDLLGAKGDMGLLWGQLTHALACRHCGSSCFQSPGNLVTLFLFVVWQIQRWWQLGRLRQLHPWCSGNMVQGKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKWSVCSSVFFNKLAFLPRSNLLLPQYHSSAQFSTHGAHTMEDLEGMAPDPQLLPPPSSPSVSSLLLHLRPFPVDHKGVLSGAEAPTQSPGTSPLEVLPGYETHLETTGHKKMPQAFEPPMPPPCQSPASLSEPRKVSPEGGLAISKDFWGTVGYREKPQASESSMPVPCPPLDSLPELQRESSLEDPSRYKPQWECRENSGNLWAFESPVLDLNPELSGTSPECVPPASETPWKGMQSRENIWVPADPVSPPSLPSVPLLESLVMGPQGVLSESKALWETMGQKENLWASDSPDPVHSTPPTTLMEPHRINPGECLATSEATWKDTEHSRNSSASRSPSLALSPPPALAPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPLHPVPQPPTLAEAVKIERTHPGLPKGVTCPGVKAEAPLSQRWTVPELLTHPGIHAWQWSRELKLRLKKLRQSPASRAPGPSQSFCSSPILSSTIPDFWGLPSCPPQQIYPPNPCPHSSSCHPQEVQRTVPQPVQSSHCHHFQSSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 10895 - protein, 1006 aa, Homo sapiens
MLRKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKWSVCSSVFFNKLAFLPRSNLLLPQYHSSAQFSTHGAHTMEDLEGMAPDPQLLPPPSSPSVSSLLLHLRPFPVDHKGVLSGAEAPTQSPGTSPLEVLPGYETHLETTGHKKMPQAFEPPMPPPCQSPASLSEPRKVSPEGGLAISKDFWGTVGYREKPQASESSMPVPCPPLDSLPELQRESSLEDPSRYKPQWECRENSGNLWAFESPVLDLNPELSGTSPECVPPASETPWKGMQSRENIWVPADPVSPPSLPSVPLLESLVMGPQGVLSESKALWETMGQKENLWASDSPDPVHSTPPTTLMEPHRINPGECLATSEATWKDTEHSRNSSASRSPSLALSPPPALAPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPLHPVPQPPTLAEAVKIERTHPGLPKGVTCPGVKAEAPLSQRWTVPELLTHPGIHAWQWSRELKLRLKKLRQSPASRAPGPSQSFCSSPILSSTIPDFWGLPSCPPQQIYPPNPCPHSSSCHPQEVQRTVPQPVQSSHCHHFQSSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 10896 - protein, 1031 aa, Homo sapiens
MLRKIQRWWQLGRLRQLHPWCSGNMVQGKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKWSVCSSVFFNKLAFLPRSNLLLPQYHSSAQFSTHGAHTMEDLEGMAPDPQLLPPPSSPSVSSLLLHLRPFPVDHKGVLSGAEAPTQSPGTSPLEVLPGYETHLETTGHKKMPQAFEPPMPPPCQSPASLSEPRKVSPEGGLAISKDFWGTVGYREKPQASESSMPVPCPPLDSLPELQRESSLEDPSRYKPQWECRENSGNLWAFESPVLDLNPELSGTSPECVPPASETPWKGMQSRENIWVPADPVSPPSLPSVPLLESLVMGPQGVLSESKALWETMGQKENLWASDSPDPVHSTPPTTLMEPHRINPGECLATSEATWKDTEHSRNSSASRSPSLALSPPPALAPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPLHPVPQPPTLAEAVKIERTHPGLPKGVTCPGVKAEAPLSQRWTVPELLTHPGIHAWQWSRELKLRLKKLRQSPASRAPGPSQSFCSSPILSSTIPDFWGLPSCPPQQIYPPNPCPHSSSCHPQEVQRTVPQPVQSSHCHHFQSSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 10897 - protein, 554 aa, Homo sapiens
MVQGKELPLLHRVAFLDHLCKQKSEVEEEGEEEEEGEDEASLDPPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPLHPVPQPPTLAEAVKIERTHPGLPKGVTCPGVKAEAPLSQRWTVPELLTHPGIHAWQWSRELKLRLKKLRQSPASRAPGPSQSFCSSPILSSTIPDFWGLPSCPPQQIYPPNPCPHSSSCHPQEVQRTVPQPVQSSHCHHFQSSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 10898 - protein, 190 aa, Homo sapiens
MALRGHPEPQPTNTPLSATVGGPISLFTQPRCHSAARDLVWSQAWPDPDVLEISMQTPGGSSCRKEAVLPRLRVTRPLVPEPAILPVCAARLAGSLATDLSRSHSLLPPWVDLKEPPPPSAPSLLLEDPGQGGCHGAQSCVGTCELANGARGFCPEMGQNESLSEERKGHESKRKSGGRGSPSSHPTQAS

SEQ ID NO: 10899 - protein, 230 aa, Homo sapiens
MLGTQWTLARCLLPSHPDPGLAGSLRGDSSEDGRRGQLLPQSPAPCSPVWSPGTPVGGPHPAGDGPATAPGPPEGPELAFPQDLSPAWPQKGAGTHPANAGPGPLSRRSSQLRTPLEAGRKWGWKMTRWRLRRDQAPGEGTQAKLLGEALSTAGRGHAGPPEGWAGEGGVSPGLTPLLGTGQGKELDLDLREKFIRFDQILGISLDHIPFLPQTGPGRPWGCGVGKQRPH

SEQ ID NO: 10900 - protein, 204 aa, Homo sapiens
MDPLSPPLCTLPPGPEPPRFVCYCEGEESGEGDRGGFNLYVTDAAELWSTCFTPDSLAALKARFGLSAAEDITPRFRAACEQQAVALTLQEDRASLTLSGGPSALAFDLSKVPGPEAAPRLRALTLGLAKRVWSLERRLAAAEETAVSPRKSPRPAGPQLFLPDPDPQRGGPGPGVRRRCPGESLINPGFKSKKPAGGVDFDET

SEQ ID NO: 10901 - protein, 58 aa, Homo sapiens
MPNRHKTKDQTLLPAQQYIWLLNSHTQMTAPVPQFKLSETASLLCKRKISTAMSSTCL

SEQ ID NO: 10902 - protein, 152 aa, Homo sapiens
  MOD_RES (1)..(1): Any amino acid
XGRPPHKGAPRLGRGVGALVPAPRAGSHPPAGVCASVHRNAVGAGGPARAGQPGLDGTGRRGARAGGERPEGRAPKVWNPPSPLWSEEVYSTAPYYTSWARGPRCPPELCAPPLKRKEQTEPTPSVRHPTMMRYLVEQTNSATENDESCLKK

SEQ ID NO: 10903 - protein, 228 aa, Homo sapiens
MEDSPLPDLRDIELKLGRKVPESLVRSLRGEEPVPRERDRDPCGGSGGGGGGGGGCSSSSSYCSFPPSLSSSSSSSPTSGSPRGSHSSALERLETKLHLLRQEMVNLRATDVRLMRQLLVINESIESIKWMIEEKATITSRGSSLSGSLCSLLESQSTSLRGSYNSLHDGSDGLDGISVGSYLDTLADDVPGHQTPSDLDQFSDSSLIEDSQALHKRPKLDSEYYCFG

SEQ ID NO: 10904 - protein, 239 aa, Homo sapiens
MEGLPCPCPALPHFWQLRSHLMAEGSRTQAPGKGPPLSIQFLRAQYEGLKRQQRTQAHLLVLPKGGNTPAPAESMVNAVWINKERRSSLSLEEADSEVEGRLEEAAQGCLQAPKSPWHTHLEMHCLVQTSPQDTSHQVHHRGKLVGSDQRLPPEGDTHLFETNQMTQQGTGIPEAAQLPCQVGNTQTKAVESGLKFSTQCPLSIKNPHRSGKPAYYPFPQRKTPRISQAARNLGLYGSA

SEQ ID NO: 10905 - protein, 95 aa, Homo sapiens
MFLTGDTSPAEDNREATLPQCSLPELYACIENFNKESKKSNLLKMHGISLNEAQEVLARNLNVMSFTRGADVRGDLQPVIRKTIHESKGSGMEIF

SEQ ID NO: 10906 - protein, 101 aa, Homo sapiens
MFLTGDTSPAEDNREATLPQCSLPELYACIENFNKESKKSNLLKMHGISLNEAQEVLARNLNVMSFTRGADVRGDLQPVISVNKMNKPGKHRKTPSPKINK

SEQ ID NO: 10907 - protein, 185 aa, Homo sapiens [sequence omitted]

SEQ ID NO: 10908 - protein, 159 aa, Homo sapiens
RGLEESGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEALGKWTDIMAAVLMSTVLCGRSLG

SEQ ID NO: 10909 - protein, 295 aa, Homo sapiens [sequence omitted]

SEQ ID NO: 10910 - protein, 441 aa, Homo sapiens
MRGLEESGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEGGAIYLSGIDMIHGTPVLDIKPYIAEYDSPQNVMEPLADFNLQNNQHTPNTVSQSDSKTDSCDQRQLSGCDEPQPHHSTKRKPKCPEDRTSEENYLTHSDTARIQQAFPMHREIAVDFGLESRRDQSSSVAEEQIGPYCPEKSFSEKGTDKKLERVEGAAVLQGSRAETQPMAPHCPAGRADGAPRSVVPAWVTEAPVATLEVRFTPHAEMDLGQLSSQDVGQASFKYFQSAEEAKRAIEAVLSADPRSVYRRKLCQDRLFYFTVDIAHVTCWFGDGFAEVLRIKPASEPVHMTGPVGSLVSLGS

SEQ ID NO: 10911 - protein, 172 aa, Homo sapiens
GLEESGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEGNPFHFYFYLFPHPKKPYKINSIHHWLFIQTSTNDVNS

SEQ ID NO: 10912 - protein, 83 aa, Homo sapiens
MSGPNGDLGMPVEAGAEGEEDGFGEAEYAAINSMLDQINSCLDHLEEKNDHLHARLQELLESNRQTRLEFQQQLGEAPSDASP

SEQ ID NO: 10913 - protein, 203 aa, Homo sapiens
MPGPLTCTPAWQGQGRAAAFLCCSFQRAGAVVGVPARWHRGRLSSQQRLRSSLGGSHPCPQLGRRLVREGVISVPRQQGRRRCRESFSPADVAPGPICSANICLSGVRFLTCLNRVREHVVGPSPSPAAPICFFPVVEALCTLRGRRCHCLPFPKRGMQRWMLPLRRGARLLPLASSKNPRARSPGLDPLGSSETLWSHRGGH

SEQ ID NO: 10914 - protein, 144 aa, Homo sapiens
MDPQEMVVKNPYAHISIPRAHLRPDLGQQLEVASTCSSSSEMQPLPVGPCAPEPTHLLQPTEVPGPKGAKGNQGAAPIQNQQAWQQPGNPYSSSQRQAGLTYAGPPPAGRGDDIAHHCCCCPCCHCCHCPPFCRCHSCCCCVIS

SEQ ID NO: 10915 - protein, 121 aa, Homo sapiens
MWSRRGLGVSRAPLHLLLGVWGPSGRTGGQRKGASLARPGRGGLASCSVGANGKRDVLFLRKTLTNTVEDIQIDNFRRKSDLGVGSPDWKNLLIDVTREDHENSQNNSKRRCKVNCETDQR

SEQ ID NO: 10916 - protein, 320 aa, Homo sapiens
MPEARSSGPDLTRWRKQQQPVRRTVSQVCPPPRRPLTVADIRSGMENERLGVVRDSMFQNPLIVKAAGPASVGTSYSVYDSSAVQKVIPSLAGHHIKGGPQAELGKPRERSYSLPGINFNYGLYIRGLDGGVPEAIGRWNVFKQQPTCPHELTRNYIAMNRGAVKAGLVTARENLLYRQLNDIRISDQDDRRMKKEPPPLPPNMTFGIRARPSTPFFDLLQHRYLQLWVQEQKATQKAIKLEKKQKVVLGKLYETRSSQLRKYKPPVKLDTLWHMPHFQKVGRHLDTFPTEADRQRALKAHREECAVRQGTLRMGNYTHP

SEQ ID NO: 10917 - protein, 284 aa, Homo sapiens
MPEARSSGPDLTRWRKQQQPVRRTVSQVCPPPRRPLTVADIRSGMENERLGVVRDSMFQNPLIVKAELGKPRERSYSLPGINFNYGLYIRGLDGGVPEAIGRWNVFKQQPTCPHELTRNYIAMNRGAVKAGLVTARENLLYRQLNDIRISDQDDRRMKKEPPPLPPNMTFGIRARPSTPFFDLLQHRYLQLWVQEQKATQKAIKLEKKQKVVLGKLYETRSSQLRKYKPPVKLDTLWHMPHFQKVGRHLDTFPTEADRQRALKAHREECAVRQGTLRMGNYTHP

SEQ ID NO: 10918 - protein, 976 aa, Homo sapiens
MTRTDPPDLLVSTVYQDIKVATPGPASKCSPCERSVARPAEPAPFNKRHCRSFDFLEALDGPAMETLPEPPPPESAVPRARTREAEPRRRARSKSAPRAPPGLTPAPASPPVLPRRGREAQRAARAEASPRREPAYPALRALANELHPIKLQPQRGGPGRVAPLCAAAGRCAPPEPPAGPAPHVRCRLDIKPDDAVLQHATRGSRSCGPTEAAHWARPAPQFHGLTVPGPRHMALSRTPTPSDSYCADPRAFYCDGPLPGPRDYAERRSLPFTTPPGPTQFFYTEEPQGFRGSFAASPGPTFDAYYPRPYPSEELSGPSPRRMGGYYAGEVRTFPIQEPPSRSYYGEAPRAYGLPYGPRYVPEEPRAHSTARPFYTEDFGRYRERDVLARTYPHPRSSPAWADWGPRPYRTLQVVPPSDPDPLLASWHGGTGTSPPRLATDSRHYSRSWDNILAPGPRREDPLGRGRSYENLLGREVREPRGVSPEGRRPPVVVNLSTSPRRYAALSLSETSLTEKGRAGEGLGRNWYVTPEITITDNDLRATERPSARAWELPGGRTRPPPHAAPDGPTSGRQRSLEQLDELITDLVIDSRPTAGQASEPAADCLGPQLRRLLDSRPAGSGAPALAPPRSPPASAGSAEEPAAPGEAADASPEPSADEDDLMTCSNARCRRTETMFNACLYFKSCHSCYTYYCSRLCRREDWDAHKARCVYGRVGSVCRHVLQFCRDSGPVHRAFSRIARVGFLSRGRGVLFLGFPSPGSADNFLRFGLEGLLLSPTYLSLRELATHAAPLGSYARELAAAGRLYEPAECFLLSVSVAVGPGTAPPGTPALPAPAPRSHGPTVRKFAKVALAAGSPARPPPARSREPDMETLILTPPPGTAGLDQDGEAGRRAREVAFIHIQRELRLRGVFLRHEFPRVYEQLCEFVEANRRFTPTTIYPTDRRTGRPFMCMIMAASEPRALDWVASANLLDDIM

SEQ ID NO: 10919 - protein, 386 aa, Homo sapiens
MMNSDQKAVKFLANFYINGGKHWTHGHLRQTQPEPTQPKASVLLLGPEPGMAWDETQPPKMKEIPVGLRLQTGTPQESLPTYTQTLRELLLEQRPLITADLEVPSPTRYQVPSPSVRESSPHPHYSIGCKHQGREGGGRRAWQTLWFQSESPFTQKADFDQEQKWPSPAHYQLLSRPAFPAFSFRGCHSASKTPEGHTHLGLPGARGLGLRVQPQSLLQASLQAPGKRCPGPNTYNILPGSRLQSPRSPAFSMSRSPAFTSWLSTSFSFGSPNPWPSRLPRGGLQLTLPFGAWRGHPGCTQTQAPRHRPLLHALEPAGHNLLGPATEWNHGLPRGFPRPPLGLGAPAWPSDPLGTPMHPSGWPTLLWAVDKAGPAWIPHLPISPLH

SEQ ID NO: 10920 - protein, 308 aa, Homo sapiens
MMNSDQKAVKFLANFYINGGKHWTHGHLRQTQPEPTQPKASVLLLGPEPGMAWDETQPPKMKEIPVGLRLQTGTPQESLPTYTQTLRELLLEQRPLITADLEVPSPTRYQVPSPSVRESSPHPHYSIGCKHQGREGGGRRAWQTLWFQSESPFTQKADFDQEQKWPSPAHYQLLSRPAFPAFSFRGCHSASKTPEGHTHLGLPGARGLGLRVQPQSLLQASLQAPGKRCPGPNTYNILPGSRLQSPRSPAFSMSRSPAFTSWLSTSRTPGPAAYHVEDCNSRFPSAPGVVIQGVRRPKRHDTGPFCTL

SEQ ID NO: 10921 - protein, 182 aa, Homo sapiens
MAAPAPVTRQVSGAAALVPAPSGPDSGQPLAAAVAELPVLDARGQRVPFGALFRERRAVVVFVRHFLCYICKEYVEDLAKIPRSFLQEANVTLIVIGQSSYHHIEPFCKLTGYSHEIYVDPEREIYKRLGMKRGEEIASSGNNIHFIHRDRNRLDHKPINSVLQLVGVQHVNFTNRPSVIHV

SEQ ID NO: 10922 - protein, 226 aa, Homo sapiens
MAAPAPVTRQVSGAAALVPAPSGPDSGQPLAAAVAELPVLDARGQRVPFGALFRERRAVVVFVRHFLCYICKEYVEDLAKIPRSFLQEANVTLIVIGQSSYHHIEPFCKLTGYSHEIYVDPEREIYKRLGMKRGEEIASSGQSPHIKSNLLSGSLQSLWRAVTGPLFDFQGDPAQQGGTLILGPGNNIHFIHRDRNRLDHKPINSVLQLVGVQHVNFTNRPSVIHV

SEQ ID NO: 10923 - protein, 110 aa, Homo sapiens
  MOD_RES (1)..(1): Any amino acid
XYVEDLAKIPRSFLQEANVTLIVIGQSSYHHIEPFCKLTGYSHEIYVDPEREIYKRLGMKRGEEIASSGNNIHFIHRDRNRLDHKPINSVLQLVGVQHVNFTNRPSVIHV

SEQ ID NO: 10924 - protein, 180 aa, Homo sapiens
  MOD_RES (1)..(1): Any amino acid
XGPRPPRVMAAPAPVTRQHFLCYICKEYVEDLAKIPRSFLQEANVTLIVIGQSSYHHIEPFCKLTGYSHEIYVDPEREIYKRLGMKRGEEIASSGQSPHIKSNLLSGSLQSLWRAVTGPLFDFQGDPAQQGGTLILGPGNNIHFIHRDRNRLDHKPINSVLQLVGVQHVNFTNRPSVIHV

SEQ ID NO: 10925 - protein, 163 aa, Homo sapiens
MEHYRKAGSVELPAPSPMPQLPPDTLEMRVRDGSKIRNLLGLALGRLEGGSARHVVFSGSGRAAGKAVSCAEIVKRRVPGLHQLTKLRFLQTEDSWVPASPDTGLDPLTVRRHVPAVWVLLSRDPLDPNECGYQPPGAPPGLGSMPSSSCGPRSRRRARDTRS

SEQ ID NO: 10926 - protein, 163 aa, Homo sapiens; identical to SEQ ID NO: 10925

SEQ ID NO: 10927 - protein, 164 aa, Homo sapiens
METAVRGMPLECPPRPERLNAYEREVMVNMLNSLSRNQQLPRITPRCGCVDPLPGRLPFHGYESACSGRHYCLRGMDYYASGAPCTDRRLRPWCREQPTVRCVPPYEHRPGMQCAVTTPPPSYYPYPNLRWDTSHFKKSGGPQRNNYVIHPEFVSETYPDYRCW

SEQ ID NO: 10928 - protein, 111 aa, Homo sapiens
METAVRGMPLECPPRPERLNAYEREVMVNMLNSLSRNQQLPRITPRCGCVPPYEHRPGMQCAVTTPPPSYYPYPNLRWDTSHFKKSGGPQRNNYVIHPEFVSETYPDYRCW

SEQ ID NO: 10929 - protein, 164 aa, Homo sapiens; identical to SEQ ID NO: 10927

SEQ ID NO: 10930 - protein, 127 aa, Homo sapiens
METAVRGMPLECPPRPERLNAYEREVMVNMLNSLSRNQQLPRITPRCGCVDPLPGRLPFHGYESACSGRHYCLRGMDYYASGAPCTDRRLRPWCREQPTMCTSLRAPARNAVCCYNSPAVILPISEP

SEQ ID NO: 10931 - protein, 126 aa, Homo sapiens
  MOD_RES (1)..(1): Any amino acid
XAWEANKFLTPGLTHTMERHVDPEALQKMAKCAVQDYTYRGSISGHPYLPEKYWLSQEEADKCSPNYLGSDWYNTWRMEPYNSSCCNKYTTYLPRLPKVSVAPSTDVWGLGHAYPTTSQTTVTDIS

SEQ ID NO: 10932 - protein, 168 aa, Homo sapiens
MMEEIDRFQVPTAHSEMQPLDPAAASISDGDCDAREEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 10933 - protein, 156 aa, Homo sapiens
MEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDRCVWGLGGSWAAQRNLYSTSGLYRPHLLYCQNWDILQPESLQG

SEQ ID NO: 10934 - protein, 172 aa, Homo sapiens
MEEIDRFQDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEINQDLNIQLLKDGYRLDEIPDDEDLDLIPPKSVNPTCMCCQATSSTACHIQ

SEQ ID NO: 10935 - protein, 156 aa, Homo sapiens
MEEIDRFQDPAAASISDGDCDAREEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 10936 - protein, 164 aa, Homo sapiens
MEEIDRFQVPTAHSEMQPLDPAAASISDGDCDAREEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPNQVSPCSLIYFQEGVWKT

SEQ ID NO: 10937 - protein, 166 aa, Homo sapiens
MEEIDRFQVPTAHSEMQPLDPAAASISDGDCDAREEKQRELARKGSLKNGSMGSPVNQQPKKNNVMARTRLVVPNKGYSSLDQSPDEKPLVALDTDSDDDFDMSRYSSSGYSSAEINQDLNIQLLKDGYRLDEIPDDEDLDLIPPKSVNPTCMCCQATSSTACHIQ

SEQ ID NO: 10938 - protein, 183 aa, Homo sapiens
MEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEINQDLNIQLLKDGYRLDEIPDDEDLDLIPPKSVNPTCMCCQATSSTACHIQ

SEQ ID NO: 10939 - protein, 169 aa, Homo sapiens
MEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPT

SEQ ID NO: 10940 - protein, 185 aa, Homo sapiens
MMEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 10941 - protein, 50 aa, Homo sapiens
MKLLSEQQELRTVSMTAWKPRMNRKSRSRMSPIDPRHSGTPNSNRIGLST

SEQ ID NO: 10942 - protein, 50 aa, Homo sapiens; identical to SEQ ID NO: 10941

SEQ ID NO: 10943 - protein, 119 aa, Homo sapiens
MNRNILEEMLQYLLIDWIVGDQFEIQLNQQLWSLIPNNDVRRLVSHVIRTLKTDCTETHLQLACAKLISRTGLLMKLLSEQQELRTVSMTAWKPRMNRKSRSRMSIPSGPDMEETTDVS

SEQ ID NO: 10944 - protein, 98 aa, Homo sapiens
MLQYLLIDWIVGDQFEIQLNQQLWSLIPNNDVRRLVSHVIRTLKTDCTETHLQLACAKLISRTGLLMKLLSEQQELRTVSMTAWKPRMNRKSRSRMRS

SEQ ID NO: 10945 - protein, 720 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 10946 - protein, 183 aa, Homo sapiens
ADPGRAQGAGSGAAAASSPAAGEPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 10947 - protein, 819 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMASPHIMFLSQSILTGGNHLCGTRLCHEIAHAWFGLAIGARDWTEEWLSEGFATHLEDVFWATAQQLAPYEAREQQELRACLRWRRLQDEMQCSPEEMQVLRPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 10948 - protein, 164 aa, Homo sapiens
MQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKTLNWSHLRNRERRRKKWITFKTLGGILFTVKQMRNLFAQV

SEQ ID NO: 10949 - protein, 186 aa, Homo sapiens
MEYPCRFQNASATTQEIIPHRVFAPVCLTGACQETLLRLIPPCLSAAHSVLGAHPFSRLDVLIVPANFPSLGMASPHIMFLSQSILTGGNHLCGTRLCHEIAHAWFGLAIGARDWTEEWLSEGFATHLEDVFWATAQQLAPYEAREQQELRACLRWRRLQDEMQCSPEEMQVLRFPHVGGCSGSFS

SEQ ID NO: 10950 - protein, 508 aa, Homo sapiens
VVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQVGVIFQQMGIL

SEQ ID NO: 10951 - protein, 181 aa, Homo sapiens
MRMRRPLAGGGKSWGIAHFYKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 10952 - protein, 140 aa, Homo sapiens
SSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGR

SEQ ID NO: 10953 - protein, 601 aa, Homo sapiens
LFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMASPHIMFLSQSILTGGNHLCGTRLCHEIAHAWFGLAIGARDWTEEWLSEGFATHLEDVFWATAQQLAPYEAREQQELRACLRWRRLQDEMQCSPEEMQVLRPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 10954 - protein, 160 aa, Homo sapiens
MRMRRPLAGGGKSWGIAHFYKVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 10955 - protein, 184 aa, Homo sapiens
  MOD_RES (1)..(1): Any amino acid
XADPGRAQGAGSGAAAASSPAAGEPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 10956 - protein, 145 aa, Homo sapiens
  MOD_RES (1)..(1): Any amino acid
XDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKTLNWSHLRNRERRRKKWITFKTLGGILFTVKQMRNLFAQV

SEQ ID NO: 10957 - protein, 181 aa, Homo sapiens
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHPDASAQESFAVSNRELCDDEKEFIHFPVCEGTSQPEPSCSAVRITANK

SEQ ID NO: 10958 - protein, 275 aa, Homo sapiens
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHPDASAQESFAVSNRELCDDEKEFIHFPVCEGTSQPEPSCSAVRITANKNYRSKTSQEGALKKMHEEEHHQQMSILQLQLIQMNEVHVAKIQQIERECEMAEEEHRIKMEVLNKKKMYWERKLQTFTKEWPVSSFNRPFPNSP

SEQ ID NO: 10959 - protein, 134 aa, Homo sapiens
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHP

SEQ ID NO: 10960 - protein, 163 aa, Homo sapiens
MTHPLPHDSHTSGAPPLVNKSRDLANGPPFFSPLQSLWEEFLHLLFMGTLLFYRIATKALRGKATLLKSHSKQPAQPGWEPGIRAPSPVPASSLQDHSRLTSLSRTGKEQRRTLSLIRKTSGTPTESTVATAAASTTEVPSRLPWAARAGFKRTTGVCIALPT

SEQ ID NO: 10961 - protein, 144 aa, Homo sapiens
MPSSAHAHAILKDAQDSPGVVLGQGVIRAGKGWENGPESHRVRYRGKKNTDWHTRSPALTFTVLWPSCPLVPIVLGLNPGFCPCARSSGECNHSGHIIEGTRWDQGQLCLLFTLSRADIRACWRVGEQQYVSLFTHVQMQHPSL

SEQ ID NO: 10962 - protein, 176 aa, Homo sapiens
MEFHYVAQADLELLTSSNPPASASQSTGITGGSHRARPGPVHFIDKVTDKPSHSHPFALKENWNLNPEPSSPPSPLFLEAPSRQASQHHGASPGAGTSAGCPFEKCCSTEPCLSGLGDVGRGEAASLRARPGSGASRGQGPGSRVSCRRDLGKPLHAPAGFSAGEVHTTPLGNLGA

SEQ ID NO: 10963 - protein, 118 aa, Homo sapiens
MPSKTAENATFYYISSLLSSRSPVFNQSPKVKAGHMLEASQISAKNSADFFHPTPSCSELDFTLHPELADSLGAKHNYKATCLMRFLPLQRHTRSWFSLILWCIQRDDYLIGLFSCFS

SEQ ID NO: 10964 - protein, 153 aa, Homo sapiens
MQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDVCESLFYFCLF

SEQ ID NO: 10965 - protein, 409 aa, Homo sapiens
MQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKERWDPSKVNILVPGAGLGRLAWEIAMLGYACQGNEWSFFMLFSSNFVLNRCSEINKYKLYPWIHQFSNNRRSADQIRPIFFPDVDPHSLPPGSNFSMTAGDFQEIYSECNTWDCIATCFFIDTAHNVIDYIDTIWKILKPGGIWINLGPLLYHFENLANELSIELSYEDIKNVVLQYGFKVEVEKESVLSTYTVNDLSMMKYYYECVLFVVRKPQ

SEQ ID NO: 10966 - protein, 196 aa, Homo sapiens
MQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKER

SEQ ID NO: 10967 - protein, 238 aa, Homo sapiens
VLRLQLESDRHDLLRSTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKERWDPSKVNILVPGAGLGRLAWEIAMLGYACQGNEWSFFMLFSSNFVLNRCSEINKYKLYPWIHQFSNNRRSADQIRPIFFPDVDPHSLPPGSNFSMTAGDFQEI

SEQ ID NO: 10968 - protein, 461 aa, Homo sapiens
MDLPDESQWDETTCGLAVCQHPQCWATIRRIERGHPRILGSSCKTPLDAEDKLPVLTVVDILDSGFAAHHLPECTFTKAHSLLSQSSKFYSKFHGRPPKGLPDKSLINCTNRLPKFPVLNLNETQLPCPEDVRNMVVLWIPEETEIHVSQHGKKKRKNSAVKSKSFLGLSGNQSAGTRVGTPGMIVPPPTPVQLSEQFSSDFLPLWAQSEALPQDLLKELLPGGKQTMLCPEMKIKLAMMKKNLPLEKNRPDSVISSKMFLSIHRLTLERPALRYPERLKKLHNLKTEGYRKQQQRQQQQQQQQKKVKTPIKKQEAKKKAKSDPGIQSTSHKHPVTTVHDRLYGYRTLPGQNSDMKQQQQMEKGTTSKQDSTERPKMNYYDHADFHHSVKSPELYETEPTNKDISAPVDAVPEAQAARQKKISFNFSEIMASTGWNSELKLLRILQDTDDEDEEDQSSGAE

SEQ ID NO: 10969 - protein, 461 aa, Homo sapiens; identical to SEQ ID NO: 10968

SEQ ID NO: 10970 - protein, 908 aa, Homo sapiens
MADGGGPKDAPSLRSSPGPAPRVPRAVGPSGGGGETPRTAALALRFDKPIKQAFYNTGAVLFVCLCCGAAVLVYFILEAFLRPLLWAVLCGTFLHPFKSSLTRLGRHWLQRLHRAHTPIVLAALLLPLCFVDYGVEALGEQALRRRRLLLLLGAGGPLLYGLYCLGSYLGVQVLLVHAATLICRGLDYFSSLWIWTLVVGYVLTVSFKWNASTERYLRAVSIPVWIILLFHLASLAGSWRIPVFLVIVFLMSVGTLYEKQNGKESSGAELPGQVISMAASTLANLAISITGYESSSEDQPSTQPAEAVDRGESAPTLSTSPSPSSPSPTSPSPTLGRRRPEIGTFLRKKKTSDIYFVSLVWAIVVMQIWLNLWIVQLLPVPIAVWILKKLVIHFGVVDFLEKRYHVWWGIIESFLKERQGALAPWPIVGLGKFLLKVDSKLWHWLNKKMIIWLEKMLDKIISIFIIFLLVIGTLLLALLLTAKVHQESVHMIEVTSNLINETLANHPEWANWLPEAQVVQRALNSAANNVYQYGREWITHKLHKILGDKVNNTAVIEKQVLELWDRLYHSWFVKNVTHSGRHKGQKLHVSRQNSWLGDILDWQDIVSFVHENIETFLSILESLWIVMSRNVSLLFTTVTTLLTILFYSGTALLNFVLSLIIFLTTLFYLLSSSDEYYKPVKWVISLTPLSQPGPSSNIIGQSVEEAIRGVFDASLKMAGFYGLYTWLTHTMFGINIVFIPSALAAILGAVPFLGTYWAAVPAVLDLWLTQGLGCKAILLLIFHLLPTYFVDTAIYSDISGGGHPYLTGLAVAGGAYYLGLEGAIIGPILLCILVVASNIYSAMLVSPTNSVPTPNQTPWPAQPQRTFRDISRSEIFSVDVVSSAVIFRKFKFDSEFSSAVALCPSSCA

SEQ ID NO: 10971 - protein, 879 aa, Homo sapiens [sequence omitted]

SEQ ID NO: 10972 - protein, 502 aa, Homo sapiens
MADGGGPKDAPSLRSSPGPAPRVPRAVGPSGGGGETPRTAALALRFDKPIKQAFYNTGAVLFVCLCCGAAVLVYFILEAFLRPLLWAVLCGTFLHPFKSSLTRLGRHWLQRLHRAHTPIVLAALLLPLCFVDYGVEALGEQALRRRRLLLLLGAGGPLLYGLYCLGSYLGVQVLLVHAATLICRGLDYFSSLWIWTLVVGYVLTVSFKWNASTERYLRAVSIPVWIILLFHLASLAGSWRIPVFLVIVFLMSVGTLYEKQNGKESSGAELPGQVISMAASTLANLAISITGYESSSEDQPSTQPAEAVDRGESAPTLSTSPSPSSPSPTSPSPTLGRRRPEIGTFLRKKKTSDIYFVSLVWAIVVMQIWLNLWIVQLLPVPIAVWILKKLVIHFGVVDFLEKRYHVWWGIIESFLKERQGALAPWPIVGLGKFLLKVDSKMIIWLEKMLDKIISIFIIFLLVIGTLLLALLLTAKVHQESVHMIEVTSNLINETLANHPEWA

SEQ ID NO: 10973 - protein, 431 aa, Homo sapiens
MFWRRLRPGAQDLAPKGLPGDGDFRRSSDPRLPKLTPPALRAALGARGSGDWRIPGGGAAWWPEGDAKPGVGVGRLPPRLPALLTATRRAVRKRGLLRSLLPPPLLSAGASRESAPRQPGPGERERPRRRVAREDPDFLGAFLGELLPSRFREFLHQLQEKCAEEPEPLTSPAPQHQRGVLEHCPGSPRCPNCSFLPDLWGQSSHLQDSLTKISLQQTPILGPLKGDHSQFTTVRKANHRPHGAQVPRLKAALTHNPSGEGSRPCRQRCPFRVRFADETLQDTTLRYWERRRSVQQSVIVNQKAALPVASERVFGSVGKRLESLPKALYPGAKEETLASSSCWDCAGLSTQKTQGYLSEDTSMNSSLPFCSWKKAAAQRPRSSLRAFLDPHRNLEQESLLPNRVLQSVLKQGCPKGYHLLLASATLQPDKR

SEQ ID NO: 10974 - protein, 271 aa, Homo sapiens
MRDRRGPLGTCLAQVQWAGGGDSDKLSYSLKKRMPTEGPWPADAPSWMNKPAVDGNSQSEALSLEMAGLSLPSGGPVLPYVKESARRNPASAATPSAAVGLFPAPTEYFARVSCSGVEALGRDWLGGGPRATHGHRGQCPKGEPRVSRLTRHQKLPEMGSFWDDPPSAFPSGLGSELEPSCLHSILSATLHACPEVLLKDETKRIFLDLLNPMFSKQTIEFKKMFKSTSDGLQITLGLLALQHFELANSLCHSLKYKQNNASRLILRVVLE

SEQ ID NO: 10975 - protein, 79 aa, Homo sapiens
MRQRGQEHLPTSVKSEPRACNNPTVAENRRVPSGLAAVIRNLTALWNPSLGVSERRGGDWEPSRIPRLWARVGWIQLPG

SEQ ID NO: 10976 - protein, 152 aa, Homo sapiens
MGLSPGQTSVSFLWPLLEVRDHNTGRGLVPATVLTPGSPETLLELRQAFLGSRQARHGHDAAPSSGQQGCSVDRTAGRPVLGWRLRNSLTGQEGRQHLHLSGIRTSRKAKEYKPVFFGATEISVLMAVAESLREPPPPQWGWFLSSLFLKIF

SEQ ID NO: 10977 - protein, 200 aa, Homo sapiens
MPLVEERHRILNETGKILLEKFGGSFLNCVRESENSAQKLMHLVVESFPSYRDVTLFEGKRVSFYKRAQILVADTWSVLEGKGDGCFKDISSITMFADYRLPQVLAHLGALKYSDDLLKKLLKGEMLSYGDRQEVEIRGCSLWCVELIRDCLLELIEQKGEKPNGEINSILLDYYLWDYAHDHREDMKGIPFHRIRCIYY

SEQ ID NO: 10978 - protein, 60 aa, Homo sapiens
MPLVEERHRILNETGKILLEKFGGSFLNCVRESENSAQKLMHLVVESFPSYRDVTLFECT

SEQ ID NO: 10979 - protein, 341 aa, Homo sapiens
MDGLLNPRESSKFIAENSRDVFIDSGGVRRVAELLLAKAAGPELRVEGWKALHELNPRAADEAAVNWVFVTDTLNFSFWSEQDEHKCVVRYRGKTYSGYWSLCAAVNRALDEGIPITSASYYATVTLDQVRNILRSDTDVSMPLVEERHRILNETGKILLEKFGGSFLNCVRESENSAQKLMHLVVESFPSYRDVTLFEGKRVSFYKRAQILVADTWSVLEGKGDGCFKDISSITMFADYRLPQVLAHLGALKYSDDLLKKLLKGEMLSYGDRQEVEIRGCSLWCVELIRDCLLELIEQKGEKPNGEINSILLDYYLWDYAHDHREDMKGIPFHRIRCIYY

SEQ ID NO: 10980 - protein, 295 aa, Homo sapiens
MRHSVARPTRLPRRLSPFWDPATCKNLEGGAGEVVRGRDPRRLRTSRSTEILGEDLAGPSAGAAARPAAPPPQPREPGAPGLRRAPPRTRMDSSGLGPCSEAPLHTSAGLSGRNLRAAGGVLPVDLERERAALCARQSGHGPPAVRWLLGSRGAESGGLARRRVAAEHAQPSANLVCRSALETSAFPPSKPKSPRGRVRARSSDGRLRHPAWRAGSGGRGGRGPSAELASRYWGRRRALPGAADLRPKGARADDRRPLRAGRKLHLPEAARLPGNVGKSGEPHKAGEVGNHPRDS

SEQ ID NO: 10981 - protein, 269 aa, Homo sapiens
MGPRPLEKGCFPGCFFRNSKEERHESRRPLSTSHEPIFPLNTIKMKLKENNLNRLPKGMQARAPSQYSTRHFFQDQPAQLNLGNNFKISGGSKPPFVVRHVDSAKPFGENISEHHLRRSRRKSKFSDFPFPTRRASSLDSLAANVKVIKEPDERIVLRSDSSSCLDSSQFGKSSSSKQGDADFHGKASFATYQHSTSPGPLDQPLLRERFHPGSQSTWKNIHERVCSLLTSHRAQLHQNKEDSTSEVNYIIERPSYPLKKYSLHEQRYF

SEQ ID NO: 10982 - protein, 392 aa, Homo sapiens
MPLEVVVELQIRAISCPGVFLPGKQDVYLGVYLMNQYLETNSFPSAFPIMIQESMRFEKVFESAVDPGAVVDLLEMWDELAYYEENTRDFLFPEPKLTPSHPRRCREVLMKTALGFPGIAPKIEFSTRTAIRECVFLHRNRFLEERHESRRPLSTSHEPIFPLNTIKMKLKENNLNRLPKGMQARAPSQYSTRHFFQDQPAQLNLGNNFKISGGSKPPFVVRHVDSAKPFGENISEHHLRRSRRKSKFSDFPFPTRRASSLDSLAANVKVIKEPDERIVLRSDSSSCLDSSQFGKSSSSKQGDADFHGKASFATYQHSTSPGPLDQPLLRERFHPGSQSTWKNIHERVCSLLTSHRAQLHQNKEDSTSEVNYIIERPSYPLKKYSLHEQRYF

SEQ ID NO: 10983 - protein, 135 aa, Homo sapiens
MTPTPTAAWTPPPPLRPSAAAAGAQCRSCPFRGGCAPSTARTPPACMRPAGPCAPPTWPAPSTTTSTCTSRRAGCTASSASYSTLAAACSLRRSGVRWPPSSAYSTWAFASCCASSASCRCCCCCWAAGAWTSAW

SEQ ID NO: 10984 - protein, 289 aa, Homo sapiens
MPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 10985 - protein, 175 aa, Homo sapiens
MVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAHTEKQRRAQGPALESR

SEQ ID NO: 10986 - protein, 361 aa, Homo sapiens
MTGKKSSREKRRKRSSQEAAAALAAPDIVPALASGSSGSTSGCGSAGGCGSVSCCGNANFSGSVTGGGSGGSCWGGSSVERSERRKRRSTDSSSVSGSLQQETKYILPTLEKELFLAEHSDLEEGGLDLTVSLKPVSFYISDKKEMLQQCFCIIGEKKLQKMLPDVLKNCSIEEIKKLCQEQLELLSEKKILKILEGDNGMDSDMEEEADDGSKMGSDLVSQQDICIDSASSVRENKQPEGLELKQGKGEDSDVLSINADAYDSDIEGPCNEEAAAPEAPENTVQSEAGQIDDLEKDIEKSVNEILGLAESSPNEPKAATLAVPPPEDVQPSAQQLELLELEMRARAIKALMKAGDIKKPA

SEQ ID NO: 10987 - protein, 216 aa, Homo sapiens
MLQQCFCIIGEKKLQKMLPDVLKNCSIEEIKKLCQEQLELLSEKKILKILEGDNGMDSDMEEEADDGSKMGSDLVSQQDICIDSASSVRENKQPEGLELKQGKGEDSDVLSINADAYDSDIEGPCNEEAAAPEAPENTVQSEAGQIDDLEKDIEKSVNEILGLAESSPNEPKAATLAVPPPEDVQPSAQQLELLELEMRARAIKALMKAGDIKKPA

SEQ ID NO: 10988 - protein, 1444 aa, Homo sapiens
MTDTSVLDQWKASFFVEDFLEKKTITRMVTQINCEFEEVVPSSNPDSQIEVEEVSLYTHMDYNEVFTPVSCLEKCSALQNQNQDLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLESCLEHKSHSSPIALIDEKSTNAHLSLPQKSPSLAKEVPDLCFSDDYFSDKGAAKEEKPKNDQEPVNRIIQKKENNDHFELDCTGPSIKSPSSSIIKKASFEHGKKQENDLDLLSDFIMLRNKYKTCTSKTEVTNSDEKHDKEACSLTLQEESPIVHINKTLEEINQERGTDSVIEIQASDSQCQAFCLLEAAASPILKNLVSLCTLPTANWKFATVIFDQTRFLLKEQEKVVSDAVRQGTIDEREMTFKHAALLHLLVTIRDVLLTCSLDTALGYLSKAKDIYNSILGPYLGDIWRQLEIVQFIRGKKPETNYKIQELQCQILSWMQSQQQIKVLIIIRMDSDGEKHFLIKILNKIEGLTLTVLHSNERKDFLESEGVLRGTSSCVVVHNQYIGADFPWSNFSFVVEYNYVEDSCWTKHCKELNIPYMAFKVILPDTVLERSTLLDRFGGFLLEIQIPYVFFASEGLLNTPDILQLLESNYNISLVERGCSESLKLFGSSECYVVVTIDEHTAIILQDLEELNYEKASDNIIMRLMALSLQYRYCWIILYTKETLNSEYLLTEKTLHHLALIYAALVSFGLNSEELDVKLIIAPGVEATALIIRQIADHSLMTSKRDPHEWLDKSWLKVSPSEEEMYLLDFPCINPLVAQLMLNKGPSLHWILLATLCQLQELLPEVPEKVLKHFCSITSLFKIGSSSITKSPQISSPQENRNQISTLSSQSSASDLDSVIQEHNEYYQYLGLGETVQEDKTTILNDNSSIMELKEISSFLPPVTSYNQTSYWKDSSCKSNIGQNTPFLINIESRRPAYNSFLNHSDSESDVFSLGLTQMNCETIKSPTDTQKRVSVVPRFINSQKRRTHEAKGFINKDVSDPIFSLEGTQSPLHWNFKKNIWEQENHPFNLQYGAQQTACNKLYSQKGNLFTDQQKCLSDESEGLTCESSKDETFWRELPSVPSLDLFRASDSNANQKEFNSLYFYQRAGKSLGQKRHHESSFNSGDKESLTGFMCSQLPQFKKRRLAYEKVPGRVDGQTRLRFF

SEQ ID NO: 10989 - protein, 488 aa, Homo sapiens
MFSALKYHAIDYLYENVVRKKFYRDALLLRIPSCLYQDESYHVAVTDNKFRRPWTRVSAVSVPGMTDTSVLDQWKASFFVEDFLEKKTITRMVTQINCEFEEVVPSSNPDSQIEVEEVSLYTHMDYNEVFTPVSCLEKCSALQNQNQDLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLECKYITVNISYVNIFRM

SEQ ID NO: 10990 - protein, 1444 aa, Homo sapiens; identical to SEQ ID NO: 10988

SEQ ID NO: 10991 - protein, 1058 aa, Homo sapiens
MIICLLMTLKLRYLPTKVLQLESCLEHKSHSSPIALIDEKSTNAHLSLPQKSPSLAKEVPDLCFSDDYFSDKGAAKEEKPKNDQEPVNRIIQKKENNDHFELDCTGPSIKSPSSSIIKKASFEHGKKQENDLDLLSDFIMLRNKYKTCTSKTEVTNSDEKHDKEACSLTLQEESPIVHINKTLEEINQERGTDSVIEIQASDSQCQAFCLLEAAASPILKNLVSLCTLPTANWKFATVIFDQTRFLLKEQEKVVSDAVRQGTIDEREMTFKHAALLHLLVTIRDVLLTCSLDTALGYLSKAKDIYNSILGPYLGDIWRQLEIVQFIRGKKPETNYKIQELQCQILSWMQSQQQIKVLIIIRMDSDGEKHFLIKILNKIEGLTLTVLHSNERKDFLESEGVLRGTSSCVVVHNQYIGADFPWSNFSFVVEYNYVEDSCWTKHCKELNIPYMAFKVILPDTVLERSTLLDRFGGFLLEIQIPYVFFASEGLLNTPDILQLLESNYNISLVERGCSESLKLFGSSECYVVVTIDEHTAIILQDLEELNYEKASDNIIMRLMALSLQYRYCWIILYTKETLNSEYLLTEKTLHHLALIYAALVSFGLNSEELDVKLIIAPGVEATALIIRQIADHSLMTSKRDPHEWLDKSWLKVSPSEEEMYLLDFPCINPLVAQLMLNKGPSLHWILLATLCQLQELLPEVPEKVLKHFCSITSLFKIGSSSITKSPQISSPQENRNQISTLSSQSSASDLDSVIQEHNEYYQYLGLGETVQEDKTTILNDNSSIMELKEISSFLPPVTSYNQTSYWKDSSCKSNIGQNTPFLINIESRRPAYNSFLNHSDSESDVFSLGLTQMNCETIKSPTDTQKRVSVVPRFINSQKRRTHEAKGFINKDVSDPIFSLEGTQSPLHWNFKKNIWEQENHPFNLQYGAQQTACNKLYSQKGNLFTDQQKCLSDESEGLTCESSKDETFWRELPSVPSLDLFRASDSNANQKEFNSLYFYQRAGKSLGQKRHHESSFNSGDKESLTGFMCSQLPQFKKRRLAYEKVPGRVDGQTRLRFF

SEQ ID NO: 10992 - protein, 1405 aa, Homo sapiens
MSETLGDELEILRGKMMQRRPRSAEVKYFYFFKILLRLRLAILKYLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLESCLEHKSHSSPIALIDEKSTNAHLSLPQKSPSLAKEVPDLCFSDDYFSDKGAAKEEKPKNDQEPVNRIIQKKENNDHFELDCTGPSIKSPSSSIIKKASFEHGKKQENDLDLLSDFIMLRNKYKTCTSKTEVTNSDEKHDKEACSLTLQEESPIVHINKTLEEINQERGTDSVIEIQASDSQCQAFCLLEAAASPILKNLVSLCTLPTANWKFATVIFDQTRFLLKEQEKVVSDAVRQGTIDEREMTFKHAALLHLLVTIRDVLLTCSLDTALGYLSKAKDIYNSILGPYLGDIWRQLEIVQFIRGKKPETNYKIQELQCQILSWMQSQQQIKVLIIIRMDSDGEKHFLIKILNKIEGLTLTVLHSNERKDFLESEGVLRGTSSCVVVHNQYIGADFPWSNFSFVVEYNYVEDSCWTKHCKELNIPYMAFKVILPDTVLERSTLLDRFGGFLLEIQIPYVFFASEGLLNTPDILQLLESNYNISLVERGCSESLKLFGSSECYVVVTIDEHTAIILQDLEELNYEKASDNIIMRLMALSLQYRYCWIILYTKETLNSEYLLTEKTLHHLALIYAALVSFGLNSEELDVKLIIAPGVEATALIIRQIADHSLMTSKRDPHEWLDKSWLKVSPSEEEMYLLDFPCINPLVAQLMLNKGPSLHWILLATLCQLQELLPEVPEKVLKHFCSITSLFKIGSSSITKSPQISSPQENRNQISTLSSQSSASDLDSVIQEHNEYYQYLGLGETVQEDKTTILNDNSSIMELKEISSFLPPVTSYNQTSYWKDSSCKSNIGQNTPFLINIESRRPAYNSFLNHSDSESDVFSLGLTQMNCETIKSPTDTQKRVSVVPRFINSQKRRTHEAKGFINKDVSDPIFSLEGTQSPLHWNFKKNIWEQENHPFNLQYGAQQTACNKLYSQKGNLFTDQQKCLSDESEGLTCESSKDETFWRELPSVPSLDLFRASDSNANQKEFNSLYFYQRAGKSLGQKRHHESSFNSGDKESLTGFMCSQLPQFKKRRLAYEKVPGRVDGQTRLRFF

SEQ ID NO: 10993 - protein, 157 aa, Homo sapiens
MSSQKGNVARSRPQKHQNTFSFKNDKFDKSVQTKKINAKLHDGVCQRCKEVLEWRVKYSKYKPLSKPKKCVKCLQKTVKDSYHIMCRPCACELEVCAKCGKKEDIVIPLNKETEKIEHTENNLSSNHRRSCRRNEESDDDLDFDIDLEDTGGDHQMN

SEQ ID NO: 10994 - protein, 35 aa, Homo sapiens
MSSQKGNVARSRPQKHQNTFSFKNDKFDKSVQTKC

SEQ ID NO: 10995 - protein, 179 aa, Homo sapiens
MSSQKGNVARSRPQKHQNTFSFKNDKFDKSVQTKKINAKLHDGVCQRCKEVLEWRVKYSKYKPLSKPKKCVKCLQKTVKDSYHIMCRPCACELEVCAKCGKKEDIVIPWSLPLLPRLECSGRILAHHNLRLPCSSDSPASASRVAGTTGAHHHAQLIFVFLVEMGFHYVGQAGLELLTS

SEQ ID NO: 10996 - protein, 168 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIAHSEKLPRKVLQHGTT

SEQ ID NO: 10997 - protein, 222 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIAHSEKLPRKVLQHVSEPQAHQESTRGAARPAQAIGTQPRATKHKCRQLTKASLKPRGCSKPPWRPPGGKL

SEQ ID NO: 10998 - protein, 222 aa, Homo sapiens; identical to SEQ ID NO: 10997

SEQ ID NO: 10999 - protein, 77 aa, Homo sapiens
MARFQRTKEREEDRCSLNIYYVRNTTQGTAPACVGKRMQPSPTGKGGKCCTVHGLTRKIHNVQPNLQSPILSAACVD

SEQ ID NO: 11000 - protein, 108 aa, Homo sapiens
MELNTNIKSKKGLGRRNLKPMNGAWPPARREMARFQRTKEREEDRCSLNIYYVRNTTQGTAPACVGKRMQPSPTGKGGKCCTVHGLTRKIHNVQPNLQSPILSAACVD

SEQ ID NO: 11001 - protein, 77 aa, Homo sapiens; identical to SEQ ID NO: 10999

SEQ ID NO: 11002 - protein, 74 aa, Homo sapiens
  MOD_RES (1)..(1): Any amino acid
XNGAWPPARREMARFQRTKEREEDRCSLNIYYVRNTTQGTAPACSQGRYIMYSRIYSLLFCQLLVLIKTSIKIL

SEQ ID NO: 11003 - protein, 1229 aa, Homo sapiens
MNLNTSSNTGDTQRLKIASLDVKQILKNETELDITDNLRKKLHWAKKEKLEITTKHNAELASYESQIAKLRSEVEKGEALRQSLEYDLAVARKEAGLGRRAAEERLAEAHRIQEKLCAQNSELQAKTNETEKAFQTSQQKWKEECRRFEHDLEERDNMIQNCNREYDLLMKEKSRLEKTLQEALEKHQREKNEMESHIRETALEEFRLQEEQWEAERRELQFIVQEQDTAVQNMHKKVEKLETEHMDCSDLLRRQTSELEFSTQREERLRKEFEATTLRVRKLEENIEAERAAHLESKFNSEIIQLRIRDLEGALQVEKASQAEAVADLEIIKNEFKEVESAYEREKHNAQESFAKLNLLEKEYFSKNKKLNEDIEEQKKVIIDLSKRLQYNEKSCSELQEELVMAKKHQAFLVETCENNVKELESILDSFTVSGQWTSGIHKDKDKPPSFSVVLERLRRTLTDYQNKLEDASNEEKACNELDSTKQKIDSHTKNIKELQDKLADVNKELSHLHTKCADREALISTLKVELQNVLHCWEKEKAQAAQSESELQKLSQAFHKDAEEKLTFLHTLYQHLVAGCVLIKQPEGMLDKFSWSELCAVLQENVDALIADLNRANEKIRHLEYICKNKSDTMRELQQTQEDTFTKVAEQIKAQESCWHRQKKELELQYSELFLEVQKRAQKFQEIAEKNMEKLNHIEKSHEQLVLENSHFKKLLSQTQREQMSLLAACALMAGALYPLYSRSCALSTQRDFLQEQVNTFELFKLEIRTLAQALSTVEEKKQEEAKMKKKTFKGLIRIFRKGVIAVLAANRLKILGQSCASLFTWMESFKEGIGMLVCTGEPQDKHKFPKHQKEQLRCLQALSWLTSSDLLAAIISSMAELQDVIGKADPNSRICGHLLIGAAKNSFAKLMDKISLVMECIPLHSSRSITYVEKDSLVQRLAHGLHKVNTLALKYGLRGHVPITKSTASLQKQILGFTQRLHAAEVERRSLRLEVTEFKRSVNEMKKELDKAQGLQMQLNEFKQSKLITHEKFESACEELNNALLREEQAQMLLNEQAQQLQELNYKLELHSSEEADKNQTLGEAVKSLSEAKMELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQVRVQWCDHSSLQSQMPGLKQSSCLSLLST

SEQ ID NO: 11004 - protein, 136 aa, Homo sapiens
MRAVENTLHKVRDQISLSWSAASRNDFTLQLPKLHLETFAMEGLKGGPEVVACQAMIKSFMDVYQLASTRIMTLEKEMTSHRSHIAALKSELHTACLRENASLQSDTFIISFRRDGSPCSDSSSIECETFPQVILM

SEQ ID NO: 11005 - protein, 498 aa, Homo sapiens
MAGALYPLYSRSCALSTQRDFLQEQVNTFELFKLEIRTLAQALSTVEEKKQEEAKMKKKTFKGLIRIFRKGVIAVLAANRLKILGQSCASLFTWMESFKEGIGMLVCTGEPQDKHKFPKHQKEQLRCLQALSWLTSSDLLAAIISSMAELQDVIGKADPNSRICGHLLIGAAKNSFAKLMDKISLVMECIPLHSSRSITYVEKDSLVQRLAHGLHKVNTLALKYGLRGHVPITKSTASLQKQILGFTQRLHAAEVERRSLRLEVTEFKRSVNEMKKELDKAQGLQMQLNEFKQSKLITHEKFESACEELNNALLREEQAQMLLNEQAQQLQELNYKLELHSSEEADKNQTLGEAVKSLSEAKMELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQVRVRVQWCDHSSLQSQMPGLKQSSCLSLLST

SEQ ID NO: 11006 - protein, 1326 aa, Homo sapiens
MNLNTSSNTGDTQRLKIASLDVKQILKNETELDITDNLRKKLHWAKKEKLEITTKHNAELASYESQIAKLRSEVEKGEALRQSLEYDLAVARKEAGLGRRAAEERLAEAHRIQEKLCAQNSELQAKTNETEKAFQTSQQKWKEECRRFEHDLEERDNMIQNCNREYDLLMKEKSRLEKTLQEALEKHQREKNEMESHIRETALEEFRLQEEQWEAERRELQFIVQEQDTAVQNMHKKVEKLETEHMDCSDLLRRQTSELEFSTQREERLRKEFEATTLRVRKLEENIEAERAAHLESKFNSEIIQLRIRDLEGALQVEKASQAEAVADLEIIKNEFKEVESAYEREKHNAQESFAKLNLLEKEYFSKNKKLNEDIEEQKKVIIDLSKRLQYNEKSCSELQEELVMAKKHQAFLVETCENNVKELESILDSFTVSGQWTSGIHKDKDKPPSFSVVLERLRRTLTDYQNKLEDASNEEKACNELDSTKQKIDSHTKNIKELQDKLADVNKELSHLHTKCADREALISTLKVELQNVLHCWEKEKAQAAQSESELQKLSQAFHKDAEEKLTFLHTLYQHLVAGCVLIKQPEGMLDKFSWSELCAVLQENVDALIADLNRANEKIRHLEYICKNKSDTMRELQQTQEDTFTKVAEQIKAQESCWHRQKKELELQYSELFLEVQKRAQKFQEIAEKNMEKLNHIEKSHEQLVLENSHFKKLLSQTQREQMSLLAACALMAGALYPLYSRSCALSTQRDFLQEQVNTFELFKLEIRTLAQALSTVEEKKQEEAKMKKKTFKGLIRIFRKGVIAVLAANRLKILGQSCASLFTWMESFKEGIGMLVCTGEPQDKHKFPKHQKEQLRCLQALSWLTSSDLLAAIISSMAELQDVIGKADPNSRICGHLLIGAAKNSFAKLMDKISLVMECIPLHSSRSITYVEKDSLVQRLAHGLHKVNTLALKYGLRGHVPITKSTASLQKQILGFTQRLHAAEVERRSLRLEVTEFKRSVNEMKKELDKAQGLQMQLNEFKQSKLITHEKFESACEELNNALLREEQAQMLLNEQAQQLQELNYKLELHSSEEADKNQTLGEAVKSLSEAKMELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQAMIKSFMDVYQLASTRIMTLEKEMTSHRSHIAALKSELHTACLRENASLQSIGSRDHSNLSIPSRAPLPADTTGIGDFLPLKAELDTTYTFLKETFINTVPHALTSSHSSPVTMSANANRPTQIGL

SEQ ID NO: 11007 - protein, 257 aa, Homo sapiens
  MOD_RES (1)..(1): Any amino acid
XHKVNTLALKYGLRGHVPITKSTASLQKQILGFTQRLHAAEVERRSLRLEVTEFKRSVNEMKKELDKAQGLQMQLNEFKQSKLITHEKFESACEELNNALLREEQAQMLLNEQAQQLQELNYKLELHSSEEADKNQTLGEAVKSLSEAKMELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQVRV

SEQ ID NO: 11008 - protein, 471 aa, Homo sapiens
  MOD_RES (1)..(1): Any amino acid
XFELFKLEIRTLAQALSTVEEKKQEEAKMKKKTFKGLIRIFRKGVIAVLAANRLKILGQSCASLFTWMESFKEGIGMLVCTGEPQDKHKFPKHQKEQLRCLQALSWLTSSDLLAAIISSMAELQDVIGKADPNSRICGHLLIGAAKNSFAKLMDKISLVMECIPLHSSRSITYVEKDSLVQRLAHGLHKVNTLALKYGLRGHVPITKSTASLQKQILGFTQRLHAAEVERRSLRLEVTEFKRSVNEMKKELDKAQGLQMQLNEFKQSKLITHEKFESACEELNNALLREEQAQMLLNEQAQQLQELNYKLELHSSEEADKNQTLGEAVKSLSEAKMELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQVRVRVQWCDHSSLQSQMPGLKQSSCLSLLST

SEQ ID NO: 11009 - protein, 317 aa, Homo sapiens
MNLNTSSNTGDTQRLKIASLDVKQILKNETELDITDNLRKKLHWAKKEKLEITTKHNAELASYESQIAKLRSEVEKGEALRQSLEYDLAVARKEAGLGRRAAEERLAEAHRIQEKLCAQNSELQAKTNETEKAFQTSQQKWKEECRRFEHDLEERDNMIQNCNREYDLLMKEKSRLEKTLQEALEKHQREKNEMESHIRETALEEFRLQEEQWEAERRELQFIVQEQDTAVQNMHKKVEKLETEHMDCSDLLRRQTSELEFSTQREERLRKEFEATTLRVRKLEENIEAERAAHLESKFNSEIIQVKCKQIFWPAFS

SEQ ID NO: 11010 - protein, 199 aa, Homo sapiens
MKTFIIGISGVTNSGKTTLAKNLQKHLPNCSVISQDDFFKPESEIETDKNGFLQYDVLEALNMEKMMSAISCWMESARHSVVSTDQESAEEIPILIIEGFLLFNYKPLDTIWNRSYFLTIPYEECKRRRSTRVYQPPDSPGYFDGHVWPMYLKYRQEMQDITWEVVYLDGTKSEEDLFLQVYEDLIQELAKQKCLQVTA

SEQ ID NO: 11011 - protein, 185 aa, Homo sapiens
MGKRRHRRGNVISCVTNSGKTTLAKNLQKHLPNCSVISQDDFFKPESEIETDKNGFLQYDVLEALNMEKMMSAISCWMESARHSVVSTDQESAEEIPILIIEGFLLFNYKPLDTIWNRSYFLTIPYEECKRRRSTRVYQPPDSPGYFDGHVWPMYLKYRQEMQDITWEVVYLDGTKSEEDLFLQV

SEQ ID NO: 11012 - protein, 175 aa, Homo sapiens
MKTFIIGISGVTNSGKTTLAKNLQKHLPNCSVISQDDFFKPESEIETDKNGFLQYDVLEALNMEKMMSAISCWMESARHSVVSTDQESAEEIPILIIEGFLLFNYNTRVYQPPDSPGYFDGHVWPMYLKYRQEMQDITWEVVYLDGTKSEEDLFLQVYEDLIQELAKQKCLQVTA

SEQ ID NO: 11013 - protein, 203 aa, Homo sapiens
MGKRRHRRGNVISCVTNSGKTTLAKNLQKHLPNCSVISQDDFFKPESEIETDKNGFLQYDVLEALNMEKMMSAISCWMESARHSVVSTDQESAEEIPILIIEGFLLFNYKPLDTIWNRSYFLTIPYEECKRRRSTRVYQPPDSPGYFDGHVWPMYLKYRQEMQDITWEVVYLDGTKSEEDLFLQVYEDLIQELAKQKCLQVTA

SEQ ID NO: 11014 - protein, 213 aa, Homo sapiens
MELHDRVLDVQLCACSLLLHLLGQGIIVNKAPLEKVPDLISQVLATYPADGEMAEASCGVFWLLSLLGCIKEQQFEQVVALLLQSIRLCQDRALLVNNAYRGLASLVKVSELAAFKVVVQEEGGSGLSLIKETYQLHRDDPEVVENVGMLLVHLASYEEILPELVSSSMKALLQEIKERFTSSLVSDSSAFSKPGLPPGGSPQLGCTTSGGLE

SEQ ID NO: 11015 - protein, 680 aa, Homo sapiens
MLGPGSNRRRPTQGERGPGSPGEPMEKYQVLYQLNPGALGVNLVVEEMETKVKHVIKQVECMDDHYASQALEELMPLLKLRHAHISVYQELFITWNGEISSLYLCLVMEFNELSFQEVIEDKRKAKKIIDSEWMQNVLGQVLDALEYLHHLDIIHRNLKPSNIILISSDHCKLQDLSSNVLMTDKAKWNIRAEEDPFRKSWMAPEALNFSFSQKSDIWSLGCIILDMTSCSFMDGTEAMHLRKSLRQSPGSLKAVLKTMEEKQIPDVETFRNLLPLMLQIDPSDRITIKDVVHITFLRGSFKSSCVSLTLHRQMVPASITDMLLEGNVASILEVMQKFSGWPEVQLRAMKRLLKMPADQLGLPWPPELVEVVVTTMELHDRVLDVQLCACSLLLHLLGQALVHHPEAKAPCNQAITSTLLSALQSHPEEEPLLVMVYSLLAITTTQESESLSEELQNAGLLEHILEHLNSSLKSRDVCASGLGLLWALLLDGIIVNKAPLEKVPDLISQVLATYPADGEMAEASCGVFWLLSLLGCIKEQQFEQVVALLLQSIRLCQDRALLVNNAYRGLASLVKVSELAAFKVVVQEEGGSGLSLIKETYQLHRDDPEVVENVGMLLVHLASYEEILPELVSSSMKALLQEIKERFTSSLVSDSSAFSKPGLPPGGSPQLGCTTSGGLE

SEQ ID NO: 11016 - protein, 161 aa, Homo sapiens
MLGPGSNRRRPTQGERGPGSPGEPMEKYQVLYQLNPGALGVNLVVEEMETKVKHVIKQVECMDDHYASQALEELMPLLKLRHAHISVYQELFITWNGEISSLYLCLVMEFNELSFQEVIEDKRKAKKIIDSEIKTEGVPNTRRFPVGDHDSRLFCRSLKFL

SEQ ID NO: 11017 - protein, 301 aa, Homo sapiens
MLSEGYLSGLEYWNDIHWSCASYNEQVAGEKEEETNSVATLSYSSVDETQVRSLYVSCKSSGKFISSVHSRESQHSRSQRVTVLQTNPNPVFESPNLAAVEICRDASRETYLVPSSCKSICKNYNDLQIAGGQVMAINSVTTDFPSESSFEYGPLLKSSEIPLPMEDSISTQPSDFPQKPIQRYSSYWRITSIKEKSSLQMQNPISNAVLNEYLEQKVVELYKQYIMDTVFHDSSPTQILASELIMTSVDQISLQVSREKNLETSKARDIVFSRLLQLMSTEITEISTPSLHISQYSNVNP

SEQ ID NO: 11018 - protein, 976 aa, Homo sapiens
MNTQKGSLTINVHRGSLAMSIQRGSLVPRDMDSSGRDMQLRVIPAEVKFLDTMAGRVYRLPITVHNICRWNQKIRFKEPVKPQFKLMLTSLDKELASGLQMTAMVEYHPDKDEDTFDRLLISIENKTTEIPLIGLIPSCQLEIESVVNFGTLVANSKVYSKEITITNHGKAPGIFKAEYHGQLPILIFPTSGIVDAKSSMVIKVDFCADQPRIVDEEAIVILQGQPEMLLSIKAHVVEQIIELLSMSSDRRLECIHFGPVFFGSSKIKHARVYNNSPEPINWVAIIQDDAVGEELGTDIQQRTDIALNNLTYIRKIKNIDTTIIISCLPNEGTLQPYQKTVITFCFTPKLMAVGKKDIGPSYRQDYALFLRFESVGSKDGFLRDDDYKTIKSERFQKVELALTGTGLPVLLQFDPGPVLNFKPCFMGERSEIQCIIKNQCELLPVTYHFKKTANFEIDPEKGKITGGGMVDVMCSFVPHQLGVFKVKQMIEIIGLVAEEDLQSLSVKSFHHVYLAFNSICKASTKKVVMKFDPGILPSIRNPTGKFVVKDLAKRKNYAPVAMLQSAMTRTHNHRSCEEPVKDMLLAFPNDRAATIRSKDHHKHFRPIFTKVPRFNYVNHDFAYTTFEKQQKKLHENYYAMYLKYLRSVRLQKKQAERERMYSYDDTDIGLEPGSGLKSPSLSEAEIEEELSSAANSIRANRLLTTRGIASQEEESVRRKVLKGLKSEPSTPQEKHDCSLMLTPKQIHQVIVGPSVLNFGNICVNSPNTHLLHVINMLPMHVLLQLDTDLEELQKTNQFSYVILPTSSTYISMVFDSPTIGKFWKSFTFTVNNVPSGHILVVAVVQPVTLELSSNELVLRPRGFFMKTCFRGTVRLYNRQNCCAQFQWQPVNTGRGIAFSICPAKGTVEAYSSLECEVTWQQGFSSPEEGEFILHVFQGNALKLKCVAHVIIFLEHGFCFEGYEFVGYTLVYIVTYI

SEQ ID NO: 11019 - protein, 234 aa, Homo sapiens
  MOD_RES (1)..(1): Any amino acid
XSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKGLALSPRLECGVTITAYCSLYLQDSSYLPPQPPE

SEQ ID NO: 11020 - protein, 625 aa, Homo sapiens
MARSRSRSPRWKHRSLSPVPRNAEHYKQRHSHGHYGCEYRKDPKRPVAWRMDSEKHGQSKPRIPSRGNIYYQSYEHRSPSPNIRNSLENVYMYKPHRGYSPGRGDSNRRAQYMPKYSEGIPYKEHERNSYPQKVQGGHSPDDHRVRGSGKGGKPPQRSIADSFRFEGKWHEDELRHQRIQEEKYSQSTRRGSEDFETRSSFQKRYPEDRDFRKYGHTSKRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKGLALSPRLECGVTITAYCSLYLQDSSYLPPQPPE

SEQ ID NO: 11021 - protein, 682 aa, Homo sapiens
MARSRSRSPRWKHRSLSPVPRNAEHYKQRHSHGHYGCEYRKDPKRPVAWRMDSEKHGQSKPRIPSRGNIYYQSYEHRSPSPNIRNSLENVYMYKPHRGYSPGRGDSNRRAQYMPKYSEGIPYKEHERNSYPQKVQGGHSPDDHRVRGSGKGGKPPQRSIADSFRFEGKWHEDELRHQRIQEEKYSQSTRRGSEDFETRSSFQKRYPEDRDFRKYGHTSKRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKNYTTQRKDIITHKPFEVEGNHRNTRVRPFKSNFRGGRCQPNYKSGLVQKSLYIQAKYQRLRFTGPRGFITHKFRERLMRKKKEYTDVATGI

SEQ ID NO: 11022 - protein, 488 aa, Homo sapiens
MPKYSEGIPYKEHERNSYPQKVQGGHSPDDHRVRGSGKGGKPPQRSIADSFRFEGKWHEDELRHQRIQEEKYSQSTRRGSEDFETRSSFQKRYPEDRDFRKYGHTSKRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKVNTSKCAGI

SEQ ID NO: 11023 - protein, 94 aa, Homo sapiens
MGALFRLLLQERGKAAEFYSRGRKQRRPSASCTFGGIWSSGVDMLPNGAVGSLTQLGPSRPVLGIDYSKKEFRGTAENVTGLNTILHFRKRTRS

SEQ ID NO: 11024 - protein, 232 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEPPGYNSLPLKLLGTGKAITKLFISVFRTKKERKESTMEEKKELTVEKKRTPRMEERKELIVEKKKRKESTEKTKLTKEEKKGKKLTKKSTKVVKKLCKVYREQHSRSYDSIETTSTTVLLAQTPLVKCKFLYN

SEQ ID NO: 11025 - protein, 233 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAPRIQFFAIEIARNREGYNKAVYISVQDKEGEKGVNNGGEKRADSGEEENTKNGGEKGADSGEEKEEGINREDKTDKGGEKGKEADKEINKSGEKAM

SEQ ID NO: 11026 - protein, 117 aa, Homo sapiens
MSEKKNCKNSSTNNNQTQDPSRNELQVPRSFVDRVVQDERDVQSQSSSTINTLLTLLDCLADYIMERVGLEASNNGSMRNTSQDREREVDNNREPHSAESDVTRFLFDEMPKSRKND

SEQ ID NO: 11027 - protein, 89 aa, Homo sapiens
MGELAASANHGHSPCYPERKGTPGDLSKRKMLVHFYPRRHSHPRATQQWILKNKTQEGSHLQTKRRVLSRPWICWHPDLGLPASRTMRN

SEQ ID NO: 11028 - protein, 62 aa, Homo sapiens
MGELAASANHGHSPCYPERKGTPGDLSKRKMLVHFYPRRHSHPRATQQWILKNKTLCRRIKE

SEQ ID NO: 11029 - protein, 918 aa, Homo sapiens
ILIASDGSVPLPLQFLPLQSGRYPCKILLKSRYDVRAYYVEGIVNEEQPEAKFEFETPAFEALTQNIPIKNQTNDKWTFQVTIEGEWFYGPVDLHVGPDEIVEYPLTFKPIFECVITGKLILQNEVDGREHIFDIKGVGKKPSALEHITVECQVGNVTQKHITLPHFTNTALTFKVTADLPIVWGNPQITVYPYKEILYLIHVRPWKRGILKGTITFSTTRRCTTRRKHDDYEEDTDQDQALSCLDSITEQSSILDDADTYGNFNNLRFWYNLEIHSTPGPPIEIMEMTCIALDSTCIEIPLSNPKDRGLHLEVQLTSAALNGDNEIILSPLQCTKYIVWYSPATTGYSDESIIFQPEMAEEFWYLLKLTIELPKPTTMPEIQCDLGKHVTQIIPLVNCTHETLKLQVTNSNPENFVLDINRKSQLIISPHSTTELPVLFYPSALGRADHQACINFYCTQFTEWKFYLSGVGLFPQPLDTERITTRIGLQSTIVIPFKNPTMEDVLIDIILTSVEHPRNLVMDHCWDSFIYESSAFRFSSPSEIQGIALPPKGNIDISLLFIPQIMKLHKTMVIIEMTKANGKYWPIDNFDELDIKFKSIVGIDSEEIQAIHWIYPIVGLPQAPPPKSPPVVIQCQSRKRAEEKVEIILNAGFFGFSLTPDLTEVLVIPKRNSHNFCEDPNEIPKIHEFEYEIQFESEAMKSKLESCVALYMIEKSYDIMAKRITFIFNLVFTPKKPLRSHITLKIECVTEGIWKFPIMLIATEPDTDAVIDIEGVGLFKESVFELRLKSQTRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 11030 - protein, 633 aa, Homo sapiens
MEMTCIALDSTCIEIPLSNPKDRGLHLEVQLTSAALNGDNEIILSPLQCTKYIVWYSPATTGYSDESIIFQPEMAEEFWYLLKLTIELPKPTTMPEIQCDLGKHVTQIIPLVNCTHETLKLQVTNSNPENFVLDINRKSQLIISPHSTTELPVLFYPSALGRADHQACINFYCTQFTEWKFYLSGVGLFPQPLDTERITTRIGLQSTIVIPFKNPTMEDVLIDIILTSVEHPRNLVMDHCWDSFIYESSAFRFSSPSEIQGIALPPKGNIDISLLFIPQIMKLHKTMVIIEMTKANGKYWPIDNFDELDIKFKSIVGIDSEEIQAIHWIYPIVGLPQAPPPKSPPVVIQCQSRKRAEEKVEIILNAGFFGFSLTPDLTEVLVIPKRNSHNFCEDPNEIPKIHEFEYEIQFESEAMKSKLESCVALYMIEKSYDIMAKRITFIFNLVFTPKKPLRSHITLKIECVTEGIWKFPIMLIATEPDTDAVIDIEGVGLFKESVFELRLKSQTRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 11031 - protein, 180 aa, Homo sapiens
LEIPKIHEFEYEIQFESEAMKSKLESCVALYMIEKSYDIMAKRITFIFNLVFTPKKPLRSHITLKIECVTEGIWKFPIMLIATEPDTDAVIDIEGVGLFKESVFELRLKSQTRNPEPFTAHFLPGSDLEFFVKPQAGELLPFNTNGTLITVGFKPKMYCRKYKATLVIQVSSIRAIAKDV

SEQ ID NO: 11032 - protein, 79 aa, Homo sapiens
MYRMKRSQVRTPIRRLIRNVNLDWEDSMALGCTTVIERGTLRRLKRATLNTFLDSPVHVLLVMPKLIPEHWEKWEDVKR

SEQ ID NO: 11033 - protein, 319 aa, Homo sapiens
MVLSELAARLNCAEYKNWVKAGHCLLLLRSCLQGFVGREVLSFHRGLLAAAPGLGPRAVCRGGSRCSPRARQFQPQCQVCAEWKREILRHHVNRNGDVHWGNCRPGRWPVDAWEVAKAFMPRGLADKQGPEECDAVALLSLINSCDHFVVDRKKVTEVIKCRNEIMHSSEMKVSSTWLRDFQMKIQNFLNEFKNIPEIVAVYSRIEQLLTSDWAVHIPEEDQRDGCECEMGTYLSESQVNEIEMQLLKEKLQEIYLQAEEQEVLPEELSNRLEVVKEFLRNNEDLRNGLTEDMQKLDSLCLHQKLDSQEPGRQTPDRKA

SEQ ID NO: 11034 - protein, 155 aa, Homo sapiens
MVLSELAARLNCAEYKNWVKAGHCLLLLRSCLQGFVGREVLSFHRGLLAAAPGLGPRAVCRGGSRCSPRARQFQPQCQVCAEWKREILRHHVNRNGDVHWGNCRPGRWPVDAWEVAKGLDLLSRLECSGESELIATLNSWAQAILLPQPLEYLGL

SEQ ID NO: 11035 - protein, 200 aa, Homo sapiens
MPRGLADKQGPEECDAVALLSLINSCDHFVVDRKKVTEVIKCRNEIMHSSEMKVSSTWLRDFQMKIQNFLNEFKNIPEIVAVYSRIEQLLTSDWAVHIPEEDQRDGCECEMGTYLSESQVNEIEMQLLKEKLQEIYLQAEEQEVLPEELSNRLEVVKEFLRNNEDLRNGLTEDMQKLDSLCLHQKLDSQEPGRQTPDRKA

SEQ ID NO: 11036 - protein, 200 aa, Homo sapiens; identical to SEQ ID NO: 11035

SEQ ID NO: 11037 - protein, 234 aa, Homo sapiens
MVLSELAARLNCAEYKNWVKAGHCLLLLRSCLQGFVGREVLSFHRGLLAAAPGLGPRAVCRGGSRCSPRARQVIKCRNEIMHSSEMKVSSTWLRDFQMKIQNFLNEFKNIPEIVAVYSRIEQLLTSDWAVHIPEEDQRDGCECEMGTYLSESQVNEIEMQLLKEKLQEIYLQAEEQEVLPEELSNRLEVVKEFLRNNEDLRNGLTEDMQKLDSLCLHQKLDSQEPGRQTPDRKA

SEQ ID NO: 11038 - protein, 158 aa, Homo sapiens
MKFGCLSFRQPYAGFVLNGIKTVETRWRPLLSSQRNCTIAVHIAHRDWEGDAWRELLVERLGMTPAQIQTLLRKGEKFGRGVIAGLVDIGETLQCPEDLTPDEVVELENQAVLTNLKQKYLTVISNPRWLLEPIPRKGGKDVFQVDIPEHLIPLGHEV

SEQ ID NO: 11039 - protein, 158 aa, Homo sapiens; identical to SEQ ID NO: 11038

SEQ ID NO: 11040 - protein, 158 aa, Homo sapiens; identical to SEQ ID NO: 11038

SEQ ID NO: 11041 - protein, 158 aa, Homo sapiens; identical to SEQ ID NO: 11038

SEQ ID NO: 11042 - protein, 30 aa, Homo sapiens
MKFGCLSFRQPYAGFVLNGIKTVETRWRPL

SEQ ID NO: 11043 - protein, 158 aa, Homo sapiens; identical to SEQ ID NO: 11038

SEQ ID NO: 11044 - protein, 158 aa, Homo sapiens; identical to SEQ ID NO: 11038

SEQ ID NO: 11045 - protein, 146 aa, Homo sapiens
MKFGCLSFRQPYAGFVLNGIKTVETRWRPLLSSQRNCTIAVHIAHRDWEGDAWRELLVERLGMTPAQIQTLLRKGEKFGRGVIAGLVDIGETLQCPEDLTPDEVVELENQAVLTNLKQKYLTVISNPRWLLEPIPRKGGKDVFQNP

SEQ ID NO: 11046 - protein, 158 aa, Homo sapiens
MKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVELENQAVLTNLKQKYLTVISNPRWLLEPIPRKGGKDVFQVDIPEHLIPLGHEV

SEQ ID NO: 11047 - protein, 158 aa, Homo sapiens; identical to SEQ ID NO: 11046

SEQ ID NO: 11048 - protein, 158 aa, Homo sapiens
MKFGCLSFRQPYAGFVLNGIKTVETRWRPLLSSQRNCTIAVHIAHRDWEGDACRELLVERLGMTPAQIQALLRKGEKFGRGVIAGLVDIGETLQCPEDLTPDEVVELENQAALTNLKQKYLTVISNPRWLLEPIPRKGGKDVFQVDIPEHLIPLGHEV

SEQ ID NO: 11049 - protein, 158 aa, Homo sapiens; identical to SEQ ID NO: 11048

SEQ ID NO: 11050 - protein, 158 aa, Homo sapiens; identical to SEQ ID NO: 11048

SEQ ID NO: 11051 - protein, 146 aa, Homo sapiens
MKFGCLSFRQPYAGFVLNGIKTVETRWRPLLSSQRNCTIAVHIAHRDWEGDACRELLVERLGMTPAQIQALLRKGEKFGRGVIAGLVDIGETLQCPEDLTPDEVVELENQAALTNLKQKYLTVISNPRWLLEPIPRKGGKDVFQNP

SEQ ID NO: 11052 - protein, 158 aa, Homo sapiens; identical to SEQ ID NO: 11048

SEQ ID NO: 11053 - protein, 214 aa, Homo sapiens
MESENMDSENMKTENMESQNVDFESVSSVTALEALSKLLNPEEEDDSDYGQTNGLSTIGAMGPGNIGPPQIEELKVIPETSEENNEDIWNSEEIPEGAEYDDMWDVREIPEYEIIFRQQVGTEDIFLGLSKKDSSTGCCSELVAKIKLPNTNPSDIQIDIQETILDLRTPQKKLLITLPELVECTSAKAFYIPETETLEITMTMKRELDIANFF

SEQ ID NO: 11054 - protein, 214 aa, Homo sapiens; identical to SEQ ID NO: 11053

SEQ ID NO: 11055 - protein, 214 aa, Homo sapiens; identical to SEQ ID NO: 11053

SEQ ID NO: 11056 - protein, 264 aa, Homo sapiens
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKSSSGFQDDGGLGRPKRERRSQSI

SEQ ID NO: 11057 - protein, 242 aa, Homo sapiens
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKS

SEQ ID NO: 11058 - protein, 173 aa, Homo sapiens
MRPRDRSRVIDAAKHAHKFCNTEDEETMYLRRPEGIERQYRKKCAKCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 11059 - protein, 222 aa, Homo sapiens
MPKVVSRSVVCSDTRDREEYDDGEKPLHVYYCLCGQMVLVLDCQLEKLPMRPRDRSRVIDAAKHAHKFCNTEDEETMYLRRPEGIERQYRKKCAKCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 11060 - protein, 222 aa, Homo sapiens; identical to SEQ ID NO: 11059

SEQ ID NO: 11061 - protein, 222 aa, Homo sapiens; identical to SEQ ID NO: 11059

SEQ ID NO: 11062 - protein, 208 aa, Homo sapiens
MPKVVSRSVVCSDTRDREEYDDGEKPLHVYYCLCGQMVLVLDCQLEKLPMRPRDRSRVIDAAKHAHKFCNTEDEETMYLRRCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 11063 - protein, 758 aa, Homo sapiens
MSGESGQPEAGPSHAGLDWPNPERNRAGVPGGVIRRAGSQGPRSWIQKVLEQIMDSPRQCVTPSEVVPVTVLAVQRYLLEDEPRDTVPKPPLYCYDVTISDGVYQEKCYLDPSLNSLVYQNILKVGIQMRISRVSCLYNEKRIGQGILCIDNVHCGETSDSISLETPFRNRAHQEKPERPLRGGKSHYLALWNNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKNANRPSTSQAARVEIQERNGKRHQDDEPVNSQYFQTTSTNLSLSNKIRILQGPHANPVAVPQPGASVQTKGIKPGMPSIFNRRANINANLQGKARKTISDRWESQLWREKKFGLIDHLHYSRVYPESIPRKFMFEHRKFLSDQYNSQPAKYVPPEGRPPKLDDFKSARSLGHFEVTILGLNHEIAIDVAFLPMYCPEDIRTSQIDTLLTSMNYSCAYPQDTTGNDRLPGPRAVAGDIIKAATELDRVHIVGILDICNLGNNKVEVYLHKIYSPENTS

SEQ ID NO: 11064 - protein, 855 aa, Homo sapiens
MSGESGQPEAGPSHAGLDWPNPERNRAGVPGGVIRRAGSQGPRSWIQKVLEQIMDSPRQCVTPSEVVPVTVLAVQRYLLEDEPRDTVPKPPLYCYDVTISDGVYQEKCYLDPSLNSLVYQNILKVGIQMRISRVSCLYNEKRIGQGILCIDNVHCGETSDSISLETPFRNRAHQEKPERPLRGGKSHYLALWNNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKVKNFIQWIRTKSDSGEQKNMVIGGYYPYPPVPETFSKYSSSIKVESLLTAISEVRKEIEDLQYREQKRIAIQGIITAIKYIPHSSATESASASETLRNANRPSTSQAARVEIQERNGKRHQDDEPVNSQYFQTTSTNLSLSNKIRILQGPHANPVAVPQPGASVQTKGIKPGMPSIFNRRANINANLQGKARKTISDRWESQLWREKKFGLIDHLHYSRVYPESIPRKFMFEHRKFLSDQYNSQPAKYVPPEGRPPKLDDFKSARSLGHFEVTILGLNHEIAIDVAFLPMYCPEDIRTSQIDTLLTSMNYSCAYPQDTTGNDRLPGPRAVAGDIIKAATELDRVHIVGILDICNLGNNKVEVYLHKIYSPENTS

SEQ ID NO: 11065 - protein, 566 aa, Homo sapiens
NNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKNANRPSTSQAARVEIQERNGKRHQDDEPVNSQYFQTTSTNLSLSNKIRILQGPHANPVAVPQPGASVQTKGIKPGMPSIFNRRANINANLQGKARKTISDRWESQLWREKKFGLIDHLHYSRVYPESIPRKFMFEHRKFLSDQYNSQPAKYVPPEGRPPKLDDFKSARSLGHFEVTILGLNHEIAIDVAFLPMYCPEDIRTSQIDTLLTSMNYSCAYPQDTTGNDRLPGPRAVAGDIIKAATELDRVHIVGILDICNLGNNKVEVYLHKIYSPENTS

SEQ ID NO: 11066 - protein, 332 aa, Homo sapiens
MNRSSNVPRKGILKSGTRSLQKVRRVHFANARNARSLLSMLKDISAQIIQRAWLSHTNKMIFRLLKHAICAAEFYVTHEILKKVAPLEAKLIKDPTMQCKIRFRFRGETFPPFIVFKIFLHTDGHGYKYFSGKNVLMPSSKAVDDACKLMGERKFHRIIMEDERIFPKSKVTDIMDVVTMQDYVQYRSFFDEAPAFSGGRNNSWRKLNLENIPRTMLMYDIVHYSESGVISNRLRNEMKFLLQRPVTQEIHKHQLRIVSEIRGPYLTVQPLYRPYKQQNQVKFLGRRSKQAQMKVEKMRKVYLAKEKNTSEVTEPKTGPSGTKDNYHLHSIF

SEQ ID NO: 11067 - protein, 126 aa, Homo sapiens
  MOD_RES (1)..(1): Any amino acid
XFANARNARSLLSMLKDISAQIIQRAWLSHTNKMIFRLLKHAICAAEFYVTHEILKKVAPLEAKLIKDPTMQCKIRFRFRGETFPPFIVFKIFLHTDGHGYKYFSGKNVLMPSSKVTFHDVHFMLT

SEQ ID NO: 11068 - protein, 298 aa, Homo sapiens
MACIENVLGGHAPSPLVVSVDKNGNQELHHDMPLQCLSSKPEDDAEPWGQPQVPLRPSVNVLTDLDSKQLEWPSERTGSCIPLHSLRAHRHPYGPPPAVAEESLATAEVNSSDALAGWRQEGQDAINVSWEVSGGPPALIVGGTKVNNGGTERGSNNARLHVALPQGKGFFPPRGPQVRGPSHIPTLRSGIVMEVPPGNTRIACRGKLAHVSFPLRGPCHPMHNWPRPIPLSSSTPGLPSCSTVHCFIPPRPPIFNPFLTMPLPFAPPPIFGPPLPSYFAHFHSGGMPAPASPNREHS

SEQ ID NO: 11069 - protein, 183 aa, Homo sapiens
MFIFIKHGDNQQFLVNTNCAVVVLLYYIRSKVKLPKTNTIDLCEQTGKMKMLFLMKPNHAEYASKYLTARSTYYVCKVERGPPGTRLENAYRAFVPLLKNPEPWLLVALRIQCDALERRRIQMLKMKEAKKVVIIEPPASVPSKQSGRSDKKKSTRKSPTFRNRPDFRKNKGRQLNKTTKQKK

SEQ ID NO: 11070 - protein, 203 aa, Homo sapiens
MFIFIKHGDNQQFLVNTNCAVVVLLYYIRSKVKLPKTNTIDLCEQTGKMKMLFLMKPNHAEYASKYLTARSTYYVCKVERGPPGTRLENAYRAFVPLLKNPEPWLLVALRIQCDALERRRIQMLKMKEAKKVVIIEPPASVPVRLAKCDLPQHPPLPTSRLNSKQSGRSDKKKSTRKSPTFRNRPDFRKNKGRQLNKTTKQKK

SEQ ID NO: 11071 - protein, 503 aa, Homo sapiens
MATQSDMEKEQKHQQDEGQGGLNNETALASGDACGTGNQDPAASVTTVSSQASPSGGAALSSSTAGSSAAAATSAAIFITDEASGLPIIAAVLTERHSDRQDCRSPHEVFGCVVPEGGSQAAVGPQKATGHADEHLAQTKSPGNSRRRKQPCRNQAAPAQKPPGRRLFPEPLPPSSPGFRPSSYPCSGASTSSQATQPGPALLSHASEARPATRSRITLVASALRRRASGPGPVIRGCTAQPGPAFPHRATHLDPARLSPESAPGPARRGRASVPGPARRGCDSAPGPARRGRDSAPVSAPRGRDSAPGSARRGRDSAPGPALRVRTARSDAGHRSTSTTPGTGLRSRSTQQRSALLSRRSLSGSADENPSCGTGSERLAFQSRSGSPDPEVPSRASPPVWHAVRMRASSPSPPGRFFLPIPQQWDESSSSSYASNSSSPSRSPGLSPSSPSPEFLGLRSISTPSPESLRYALMPEFYALSPVPPEEQAEIESTAHPATPPEP

SEQ ID NO: 11072 - protein, 83 aa, Homo sapiens
MEALGSGHYVGGSIRSMAAAALSGLAVRLSRPQGTRGSYGAFCKTLTRTLLTFFDLAWRLRKNFFYFYILASVILNVHLQVYI

SEQ ID NO: 11073 - protein, 182 aa, Homo sapiens
MMRRSPSGLKSPRVSQGRKPRDPESLLFLRCCLGSEPHNLSSLLSPEAGQEPLPKLLPQPLAGHAAWGIHGVPTSLLLAGECWGQGMAVPADPPPASPYRTSPRPPPGPLPRYRPQQHLLLPLGRLHALCPGCPLQQSLQFERGTLSAPRLWSWMKLETIILSKLSQGQKTKHRMFSLISES

SEQ ID NO: 11074 - protein, 182 aa, Homo sapiens; identical to SEQ ID NO: 11073

SEQ ID NO: 11075 - protein, 101 aa, Homo sapiens
MNKLGHNELKECLKTATDSLQTVQPSISQTCTSYGPALGAPLPGRNEVALLTSLPPNYEISEGKPRAISAYVRAGKGNVTRRRKKTHLGNDDGKKEAQEKM

SEQ ID NO: 11076 - protein, 101 aa, Homo sapiens; identical to SEQ ID NO: 11075

SEQ ID NO: 11077 - protein, 471 aa, Homo sapiens
MCGDCVEKEYPNRGNTCLENGSFLLNFTGCAVCSKRDFMLITNKSLKEEDGEEIVTYDHLCKNCHHVIARHEYTFSIMDEFQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 11078 - protein, 193 aa, Homo sapiens
MEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 11079 - protein, 391 aa, Homo sapiens
MIAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 11080 - protein, 472 aa, Homo sapiens
AMCGDCVEKEYPNRGNTCLENGSFLLNFTGCAVCSKRDFMLITNKSLKEEDGEEIVTYDHLCKNCHHVIARHEYTFSIMDEFQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 11081 - protein, 113 aa, Homo sapiens
MCGDCVEKEYPNRGNTCLENGSFLLNFTGCAVCSKRDFMLITNKSLKEEDGEEIVTYDPDLCKNCHHVIARHEYTFSIMDEFQEYTMLCLLCGKAEDTISILPDDPRQMTLLF

SEQ ID NO: 11082 - protein, 105 aa, Homo sapiens
MRQPYLSSREVSSSRKRWRTFPVDCVAMCGDCVEKEYPNRGNTCLENGSFLLNFTGCAVCSKRDFMLITNKSLKEEDGEEIVTYDRVYHAVSVMRQSRRYYQYSP

SEQ ID NO: 11083 - protein, 139 aa, Homo sapiens
MRQPYLSSREVSSSRKRWRTFPVDCVAMCGDCVEKEYPNRGNTCLENGSFLLNFTGCAVCSKRDFMLITNKSLKEEDGEEIVTYDHLCKNCHHVIARHEYTFSIMDEFQEYTMLCLLCGKAEDTISILPDDPRQMTLLF

SEQ ID NO: 11084 - protein, 140 aa, Homo sapiens
MRQPYLSSREVSSSRKRWRTFPVDCVAMCGDCVEKEYPNRGNTCLENGSFLLNFTGCAVCSKRDFMLITNKSLKEEDGEEIVTYDPDLCKNCHHVIARHEYTFSIMDEFQEYTMLCLLCGKAEDTISILPDDPRQMTLLF

SEQ ID NO: 11085 - protein, 126 aa, Homo sapiens [sequence omitted]

SEQ ID NO: 11086 - protein, 270 aa, Homo sapiens
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSAFGCNFIWKPTVFTRVSAFIDWIEETIASH

SEQ ID NO: 11087 - protein, 164 aa, Homo sapiens
MRSCYVAQAGLKLPGSSDPPASASQSTRITASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAG

SEQ ID NO: 11088 - protein, 121 aa, Homo sapiens
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACG

SEQ ID NO: 11089 - protein, 75 aa, Homo sapiens
WWGSTVKKTMVCAGGYIRSGCNGDSGGPLNCPTEDGGWQVHGVTSFVSAFGCNFIWKPTVFTRVSAFIDWIEEGG

SEQ ID NO: 11090 - protein, 115 aa, Homo sapiens
MDNVQPKIKHRPFCFSVKGHVKMLRLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 11091 - protein, 64 aa, Homo sapiens
INSLVTTVFMLIVSVLALIPETTTLTVGGGDLTNSIITAVFLSVVAILAMQEKKRRHLLYVGGR

SEQ ID NO: 11092 - protein, 464 aa, Homo sapiens
MRIIESNSSKIQSQIDHIKQCRAEYDTKEVKYCTFSKDPSKPIPGMTLQESMNLDALTKYMKHLEDKYAEIKQAMLIKYVPAQRKADLDEEMIVLLKRRDVAENLNKKLQFCHQRLQIISQALSSWVKSDMSSPFQDFVEQIQKTKYLQGDQGIVEELMEDDPRRAKEAEIMLHYIERFNELISLGEYEKAACYAANSPRRILRNIGTMNTFKAVGKIRGKPLPLLLFFEALFITSHAFPCPVDAALTLEGIKCGLSEKRLDLVTNWVTQERLTFSEEAGDVICDYGEQDTYNKAKCLALAQIVYSECGLHKKAILCLCKQGQTHRVMEYIQQLKDFTTDDLLQLLMSCPQVELIQCLTKELNEKQPSLSFGLAILHLFSADMKKVGIKLLQEINKGGIDAVESLMINDSFCSIEKWQEVANICSQNGFDKLSNDITSILRSQAAVTEISEEDDAVNLMEHVFW

SEQ ID NO: 11093 - protein, 220 aa, Homo sapiens
MALIFRTAMQSVGLLLSLLGWILSIITTYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGITALVPVSWVAHKTVQEFWDENVPDFVPRWEFGEALFLGWFAGLSLLLGGCLLNCAACSSHAPLALGHYAVAQMQTQCPYLEDGTADPQV

SEQ ID NO: 11094 - protein, 209 aa, Homo sapiens
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 11095 - protein, 209 aa, Homo sapiens; identical to SEQ ID NO: 11094

SEQ ID NO: 11096 - protein, 179 aa, Homo sapiens
MQEVIAGLERFTFAFEKDVEMQKGTGLLPFQGMDKSASAVCNFFTKGLCEKGKLCPFRHDRGEKMVVCKHWLRGLCKKGDHCKFLHQYDLTRMPECYFYSKFGDCSNKECSFLHVKPAFKSQDCPWYDQGFCKDGPLCKYRHVPRIMCLNYLVGFCPEGPKCQFAQKIREFKLLPGSKI

SEQ ID NO: 11097 - protein, 152 aa, Homo sapiens
MVVCKHWLRGLCKKGDHCKFLHQYDLTRMPECYFYSKFGDCSNKECSFLHVKPAFKSQDCPWYDQGFCKDAGPLCKYRHVPRIMCLNYLVGFCPEGPKCQFAHCSLPAGPGIQHLLFLLWKLGNPHPQQSACSPAWGSGVKGRACATGPLCQ

SEQ ID NO: 11098 - protein, 225 aa, Homo sapiens
MSKEIFPFCRVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSL

SEQ ID NO: 11099 - protein, 597 aa, Homo sapiens
MAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGMHVNGAPPLMQASMQGGVPAPGQMPAAVTGPGPGSLAPGGGMQAQVGMPGSGPVSMERGQGTLQHSPVGPAGPASIERVQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARAMEARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 11100 - protein, 261 aa, Homo sapiens
MHGEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 11101 - protein, 243 aa, Homo sapiens
MSPDQFLLTVSALQHARNSGEFAYPCRPQTEITDVWGPSISYPRKVLNFKGKSIQRAVDRLRLSNPPIDVKRTSIPLEIQKLQPNLKISLHSPRAQSTIPEPMIIRSRFSGSLKGGDQVTSSIERAVCSTGPLTSMQVIKPNRMLAPQVGTATLSLKKERPRIYTALDPFRVNAEFVLLTVKEEKEHQEAKMKEYQARESTGVVDPGKASKAAWIRKIKGLPIDNFTKQGKTAAPELGQNVFI

SEQ ID NO: 11102 - protein, 252 aa, Homo sapiens
MDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFFNGNCMKVIKANGRGDPVLSFFIQGNRISVCHISTFAKRINVGWNGIEPSATAQGGNASLTECAHVRLHIAGHLPASRLPVAAVQPMTGGMAPTTAPTHVLAMLILFSGV

SEQ ID NO: 11103 - protein, 752 aa, Homo sapiens
MENLESRLKNAPYFRCEKGTDSIPLCRKCETRVLAWKIFSTKEWFCRINDISQRRFLVGILKQLNSLYLLHYFQNILQTTQGKDFIYNRSRIDLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHFLGAASNPEEPWRNSLRCISEMNRLFSGKADITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLMEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFFNGNCMKVIKANGRGDPVLSFFIQGNRISVCHISTFAKRINVGWNGIEPSATAQGGNASLTECAHVRLHIAGHLPASRLPVAAVQPMTGGMAPTTAPTHVLAMLILFSGV

SEQ ID NO: 11104 - protein, 188 aa, Homo sapiens
MFSCCFPTSRGCCFRNGGSESLFRRCRRRLIPHPRRLSPVVIRRIQVPQDSLGQALAGQATPEIPLGLQLHTVLVQEIQELIEAQTLAPGPCAEVRALPAPAAEPEPAWEEAPPERALELEGAPAKDQTNEELPEITEVPESIKRRLGRRVPAATPAPRGNLLLQAWMRVHSWASRLFAPNVLPGTGP

SEQ ID NO: 11105 - protein, 122 aa, Homo sapiens
MPKKAHPSPQTPVARCNKAHPAPGPCAEVRALPAPAAEPEPAWEEAPPERALELEGAPAKDQTNEELPEITEVPESIKRRLGRRVPAATPAPRGNLLLQAWMRVHSWASRLFAPNVLPGTGP

SEQ ID NO: 11106 - protein, 281 aa, Homo sapiens
MFSCCFPTSRGCCFRNGGSESLFRQCRRRLIPHPRRLWPFVRRRTQVPQDSPGQALAGQATPEIPSGLPLHIVLVQEEIREPMEAQTHAPGPYADIAALAAPAVEPKPAWEEPPPERALEVEGAPAKDQPSQELPEIMAPTVATGLNAGAENVAGERSGREGVTSTAPASRSHAAPSPGHGGKHGGGDQGIQTGLLYLAGERLLSFAGTTALLLQGLFIVLILVGYISVKVMLKSIKTRLGRRVPAAPPALRRNLLLQAWKCVCNWASRLFAPNVLPRTGS

SEQ ID NO: 11107 - protein, 151 aa, Homo sapiens
MDARRMKKEGLTENTGLPRKLLEKHDPWPAYVTYTSQTVKRLIEKSKTRELECMRALEERPWASRQNKPSSVIQPKRRKSSKSSGKAVFRDTLSESTLSMWGAYSVLAMAPTMIPEPTHLHADSRDCPTENYNKIIFARKPMMRMLPTVRY

SEQ ID NO: 11108 - protein, 152 aa, Homo sapiens
MDARRMKKEEGLTENTGLPRKLLEKHDPWPAYVTYTSQTVKRLIEKSKTRELECMRALEERPWASRQNKPSSVIQPKRRKSSKSSGKAVFRDTLSESTLSMWGAYSVLAMAPTMIPEPTHLHADSRDCPTENYNKIIFARKPMMRMLPTVRY

SEQ ID NO: 11109 - protein, 24 aa, Homo sapiens
MDARRMKKEEGLTENTGLPRKLLE

SEQ ID NO: 11110 - protein, 208 aa, Homo sapiens
MQRPEWPRPHPGEGAAAAGRGPAPPARAGEPSGLRLQEPSLYTIKAVFILDNDGRRLLAKYYDDTFPSMKEQMVFEKNVFNKTSRTESEIAFFGGMTIVYKNSIDLFLYVVGSSYENELMLMSVLTCLFESLNHMLRKNVEKRWLLENMDGAFLVLDEIVDGGVILESDPQQVIQKVNFRADDGGLTEQSVAQVLQSAKEQIKWSLLK

SEQ ID NO: 11111 - protein, 1233 aa, Homo sapiens
MPPSWSPLMCGRAAEAAASSRTPGREMGQAVTRRLGAGARAAPRRAMDGRTPRPQDAPARREIAGSWRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRATSVTVFSKSSLQESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 11112 - protein, 1166 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 11113 - protein, 1128 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPAGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 11114 - protein, 1204 aa, Homo sapiens
MCGRAAEAAASSRTPGREMGQAVTRRLGAGARAAPRRAMDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 11115 - protein, 1166 aa, Homo sapiens
MCGRAAEAAASSRTPGREMGQAVTRRLGAGARAAPRRAMDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPAGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 11116 - protein, 139 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPT

SEQ ID NO: 11117 - protein, 157 aa, Homo sapiens
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQ

SEQ ID NO: 11118 - protein, 359 aa, Homo sapiens
MYFKRAPRAFPVLLTGAGKTTLLNYILTEQHSKRVAVILNESGEGSALEKSLAVSQGGELYEEWLELRNGCLCCSVKDNGLRAIENLMQKKGKFDDILLETTGLADPGAVTSMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 11119 - protein, 395 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVTSMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 11120 - protein, 347 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVTSMFWVDAELGSDIYLDGIITIVDSKYGLKHLTEEKPDGLINEATRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 11121 - protein, 82 aa, Homo sapiens
MLPAVGSVDEEEDPAEEDCPELVPIETTQSEEEEKSGLGAKIPVTIITGYLGAGKTTLLNYILTEQHSKRVAVILNESGEGK

SEQ ID NO: 11122 - protein, 113 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVK

SEQ ID NO: 11123 - protein, 242 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRYKMMCVKCLQIHIVYTECFLL

SEQ ID NO: 11124 - protein, 359 aa, Homo sapiens
MYFKRAPRAFPVLLTGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 11125 - protein, 347 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRSINGLGQILETQRSSLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 11126 - protein, 395 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 11127 - protein, 375 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 11128 - protein, 93 aa, Homo sapiens
  MOD_RES (1)..(1): Any amino acid
XLDLHAFDSLSGISLQKKLQHVPGTQPHLDQSIVTITFDVPGNAKEEHLNMFIQNLLWEKNVRNKDNHCMEVIRLKVQFTVADFWTKSFSWLL

SEQ ID NO: 11129 - protein, 180 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKVSHH

SEQ ID NO: 11130 - protein, 252 aa, Homo sapiens
  MOD_RES (1)..(1): Any amino acid
XAVTSMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 11131 - protein, 233 aa, Homo sapiens
  MOD_RES (1)..(1): Any amino acid
XAVTSMFWVDAELGSDIYLDGIITIVDSKYGLKHLTEEKPDGLINEATRQVALADIILINKTDLVPEEDVKKLRTTIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 11132 - protein, 139 aa, Homo sapiens
  MOD_RES (1)..(1): Any amino acid
XEEVRKRAIRMFKNEKSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 11133 - protein, 176 aa, Homo sapiens
MYFTEFPTAHVSFLPFRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 11134 - protein, 852 aa, Homo sapiens
MMPGPRPRKGPQARGQGVAAAKQMGLFMEFGPEDMLLGMDEAEDDEDLEAELLALTGEAQTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 11135 - protein, 755 aa, Homo sapiens
MRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKPMASTRRGVRPRLCRR

SEQ ID NO: 11136 - protein, 123 aa, Homo sapiens
MMPGPRPRKGPQARGQGVAAAKQMGLFMEFGPEDMLLGMDEAEDDEDLEAELLALTGEAQTTGKKPAPKGQAPLPMAHIEKLAADCMRDVEEEEEEEGLEEDAGRDCAGDDFPSFAGFRSLCT

SEQ ID NO: 11137 - protein, 858 aa, Homo sapiens
MMPGPRPRKGPQARGQGVAAAKQMGLFMEFGPEDMLLGMDEAEDDEDLEAELLALTGEAQTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEPPGHLQGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 11138 - protein, 628 aa, Homo sapiens
  MOD_RES (1)..(1): Any amino acid
XKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKPMASTRRGVRPRLCRR

SEQ ID NO: 11139 - protein, 214 aa, Homo sapiens
MLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEMERFRRSEKSHRGTQEKAASLFP

SEQ ID NO: 11140 - protein, 772 aa, Homo sapiens
  MOD_RES (1)..(1): Any amino acid
XTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 11141 - protein, 322 aa, Homo sapiens
MMTEKHEDHCLKSCSGHSYIRKNWLGCIVFPFSALLQQSEFLDQTEVLQRAQIFKKNCKAMFPNRRIVTTVFNDEGIQFLVTRYIKALNPPQQLLDIFLHNSNATFDLIARFVSLIPFVPNTPDENDGSDIWMTSEHCISLAIGNKEEHAILLCNFFLYFGKKALVLLGTSVLEGHVAYVVTQETNEYLLWNPSTGQCYKQFDPFCPLKSVDCLFDDRNVWFNIQQNNTPMAVFFDYSKESFWKQLLPKNVQGTKIQSIQVTGFPIQMPYIDVQSIIDAVYQTGIHSAEFPQTEFALAVYIHPYPNNILSVWVYLASLVQHQ

SEQ ID NO: 11142 - protein, 138 aa, Homo sapiens
MPTCLKSSISCLRHRETIKSVASDETLHEDTVHPFVEVSFQHTVYKTNTASGSHPCWNEEIKVDFVSPGHDYSFSSLSKIKDNIYINIFDEMMTEKHEDHCLKSCSGHSYIRKNWLGCIVFPFSALLQQSEDRKDSEE

SEQ ID NO: 11143 - protein, 401 aa, Homo sapiens
MMTEKHEDHCLKSCSGHSYIRKNWLGCIVFPFSALLQQSEFLDQTEVLQRAQIFKKNCKAMFPNRRIVTTVFNDEGIQFLVTRYIKALNPPQQLLDIFLHNSNATFDLIARFVSLIPFVPNTPDENDGSDIWMTSEHCISLAIGNKEEHAILLCNFFLYFGKKALVLLGTSVLEGHVAYVVTQETNEYLLWNPSTGQCYKQFDPFCPLKSVDCLFDDRNVWFNIQQNNTPMAVFFDYSKESFWKQLLPKNVQGTKIQSIQPEEIIYFETDKSMVEDLRNRIERTLKSKVMEWRPKHPTHWNRQCTFILRQILPKLEFGIGSFVSSEGDNEFERILQFYWVTGFPIQMPYIDVQSIIDAVYQTGIHSAEFPQTEFALAVYIHPYPNNILSVWVYLASLVQHQ

SEQ ID NO: 11144 - protein, 550 aa, Homo sapiens
MSHGPSPRLAESPQLSKGSLLTILGSPSPERMGPADSLPPTPPSGTPSPGPPPALPLPPAPALLADGDWESREELRLRELEEARARAAQMEKTMRRWSDCTANWREKWSKVRAERNRAREEVRQLRQRLDALTKELAGARRERQEAQGECEARGRELARLRGARGVADQTRDGPEPEAEREPVRDVGSERPPGSQELELVESLLKSMPEESEDCWEARSLGAGGPRGSSGRQERSRLPWEDTAATEEEASKLTALRLRLDESQKVLLKEREDKLALSRNIEKLEGELSQWKIKYEELSKTKQEMLKQLSILKEAHQDELGRMSEDLEDELGARSSMDRKMAELRGEMERLQAENAAEWGRRERLETEKLGLERENKKLRAQVGDLEEALARRRRQTASALDCDLRASQAALFEKNKELADLKHVHGKLKKQFQEKVAELAHANRRVEQHEAEVKKLRLRVEELKKELAQAEDELDEAHNQARKLQRSLDEQTEQSENLQVQLEHLQSRLRRQQQNAPLFGKIRSARFGTEEAEDGTSDLDEDEDLQIQVA

SEQ ID NO: 11145 - protein, 513 aa, Homo sapiens
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLRIKLEMAMKELSTLKKKQSLPPQKEALEAKVTQDLKLPGFVEESCEHTDQFQLSSQMHESIREYLVKRQFSTKEDTNNKEQGVVIDSLKLSEEMKPNLDGVDLFNNGGSGNGETKTGLRLKAINLPLENEVTEISALQVHLDEFQKILWKEREMRTALEKEIERLESALSLWKWKYEELKESKPKNVKEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQELLNLQHAYYKLNRQYQANIAELTHANNRVDQNEAEVKKLRLRVEELKQGLNQKEDELDDSLNQIRKLQRSLDEEKERNENLETELRHLQNW

SEQ ID NO: 11146 - protein, 424 aa, Homo sapiens
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLRIKLEMAMKELSTLKKKQSLPPQKEALEAKVTQDLKLPGFVEESCEHTDQFQLSSQMHESIREYLVKRQFSTKEDTNNKEQGVVIDSLKLSEEMKPNLDGVDLFNNGGSGNGETKTGLRLKAINLPLENEVTEISALQVHLDEFQKILWKERDLSFKSLKIVNTDRLNAHSFGKRNRETGVGFVSVEVEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQDVK

SEQ ID NO: 11147 - protein, 513 aa, Homo sapiens; identical to SEQ ID NO: 11145

SEQ ID NO: 11148 - protein, 237 aa, Homo sapiens
MERNDIINFKALEKELQAALTADEKYKRENAAKLRAVEQRVASYEEFRGIVLASHLKPLERKDKMGGKRTVPWNCHTIQGRTFQDVATEISPEKAPLQPETSADFYRDWRRHLPSGPERYQALLQLGGPRLGCLFQTDVGFGLLGELLVALADHVGPADRAAVLGILCSLASTGRFTLNLSLLSRAERESCKGLFQKLQAMGNPRSVKEGLSWEEQGLEEQSGGLQEEERLLQELLE

SEQ ID NO: 11149 - protein, 242 aa, Homo sapiens
MERNDIINFKALEKELQAALTADEKYKRENAAKLRAVEQRVASYEEFRGIVLASHLKPLERKDKMGGKRTVPWNCHTIQGRTFQDVATEISPEKAPLQPETSADFYRDWRRHLPSGPERYQALLQLGGPRLGCLFQTDVGFGLLGELLVALADHVGPADRAAVLGILCSLASTGRFTLNLSLLSRAERESCKGLFQKLQAMGNPRSVKEGLSWEEQGLEEQSGGLQEEERLLQELLELYQVD

SEQ ID NO: 11150 - protein, 242 aa, Homo sapiens; identical to SEQ ID NO: 11149

SEQ ID NO: 11151 - protein, 367 aa, Homo sapiens
MAAEEEDEVEWVVESIAGFLRGPDWSIPILDFVEQKCEVNCKGGHVITPGSPEPVILVACVPLVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEVKMHFANQSIEPLGRKVERSETSSLPQKDLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 11152 - protein, 342 aa, Homo sapiens
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEVKMHFANQSIEPLGRKVERSETSSLPQKDLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 11153 - protein, 514 aa, Homo sapiens
MYSQRFGTVQREVKGPTPKVVIVRSKPPKGQGAEHHLERIRRSHQKHNAILASIKSSERDRLKAEWDQHNDCKILDSLVRARIKDAVQGFIINIEERRNKLRELLALEENEYFTEMQLKKETIEEKKDRMREKTKLLKEKNEKERQDFVAEKLDQQFRERCEELRVELLSIHQKKVCEERKAQIAFNEELSRQKLVEEQMFSKLWEEDRLAKEKREAQEARRQKELMENTRLGLNAQITSIKAQRQATQLLKEEEARLVESNNAQIKHENEQDMLKKQKAKQETRTILQKALQERIEHIQQEYRDEQDLNMKLVQRALQDLQEEADKKKQKREDMIREQKIYHKYLAQRREEEKAQEKEFDRILEEDKAKKLAEKDKELRLEKEARRQLVDEVMCTRKLQVQEKLQREAKEQEERAMEQKHINESLKELNCEEKENFARRQRLAQEYRKQLQMQIAYQQQSQEAEKEEKRREFEAGVAANKMCLDKVQEVLSTHQVLPQNIHPMRKACPSKLPP

SEQ ID NO: 11154 - protein, 560 aa, Homo sapiens [sequence omitted]

SEQ ID NO: 11155 - protein, 529 aa, Homo sapiens
MAALTTVVVAAAATAVAGAVAGAGAATGTGVGATPAPQQSDGCFSTSGGIRPFHLQNWKQKVNQTKKAEFVRTAEKFKNQVINMEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKVENNVSRDPSRLYKPTKGWEERTKKIGPTGSGPLLHIPHRAIPTWRQGIQRRV

SEQ ID NO: 11156 - protein, 446 aa, Homo sapiens
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKVENNVSRDPSRLYKPTKGWEERTKKIGPTGSGPLLHIPHRAIPTWRQGIQRRV

SEQ ID NO: 11157 - protein, 377 aa, Homo sapiens
MTDDESESVLSDSHEGSELELPVIQLCGLVEELSYVNSALKTETEMFEKYYAKLEPRDQRPPRLSEIKISAADYAQFRGRRRSKSRTGMDRGVGLTADQKLELVQKEVADMKDDLRHTRANAERDLQHHEAIIEEAEIRWSEVSREVHEFEKDILKAISKKKGSILATQKVMKYIEDMNRRRDNMKEKLRLKNVSLKVQRKKMLLQLRQKEEVSEALHDVDFQQLKIENAQFLETIEARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 11158 - protein, 323 aa, Homo sapiens
MTDDESESVLSDSHEGSELELPVIQLCGLVEELSYVNSALKTETEMFEKYYAKLEPRDQRPPRLSEIKISAADYAQAIIEEAEIRWSEVSREVHEFEKDILKAISKKKGSILATQKVMKYIEDMNRRRDNMKEKLRLKNVSLKVQRKKMLLQLRQKEEVSEALHDVDFQQLKIENAQFLETIEARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 11159 - protein, 670 aa, Homo sapiens
MEGERRAYSKEVHQRINKQLEEIRRLEEVRGDLQVQISAAQNQVKRLRDSQRLENMDRLLKGRAQVQAEIEELQEQTRALDKQIQEWETRIFTHSKNVRSPGFILDQKVKIRRRIRILENQLDRVTCHFDNQLVRNAALREELDLLRIDRNRYLNVDRKLKKEIHHLHHLVSTLILSSTSAYAVREEAKAKMGLLRERAEKEEAQSEMEAQVLQRQILHLEQLHHFLKLKNNDRQPDPDVLEKREKQAGEVAEGVWKTSQERLVLCYEDALNKLSQLMGESDPDLLVQKYLEIEERNFAEFNFINEQNLELEHVQEEIKEMQEALVSARASKDDQHLLQEQQQKVLQQRMDKVHSEAERLEARFQDVRGQLEKLKADIQLLFTKAHCDSSMIDDLLGVKTSMGDRDMGLFLSLIEKRLVELLTVQAFLHAQSFTSLADAALLVLGQSLEDLPKKMAPLQPPDTLEDPPGFEASDDYPMSREELLSQVEKLVELQEQAEAQRQKDLAAAAAKLDGTLSVDLASTQRAGSSTVLVPTRHPHAIPGSILSHKTSRDRGSLGHVTFGGLSSSTGHLPSHITHGDPNTGHVTFGSTSASSGGHVTFRPVSASSYLGSTGYVGSSRGGENTEGGVESGGTASDSSGGLGSSRDHVSSTGPASSTGPGSSTSKDSRG

SEQ ID NO: 11160 - protein, 613 aa, Homo sapiens
MARCRHHSGYLADDEASHSMCSARVQLPKKPLVPEMRPACKPGRVPHPPSTCGSSALQGQRRNKRHPQPFGHFLDFLTESQVLDSLETVVEKATERMAAMKTEAGVPLVEVQDPVEVPSGGRRAHARPSLSTVHRHRVRPTLCTGHPNNYPSSSSSMSNCHSSLMAGCLGSHSRDSDLGAQGSLPPVRDKLLLEKNLKRLLQLEREGKGLSQSCSQRDSLLWDSLGSQTSFQWTQEQPLSWFSGLLGSSSGVPEASEPRPGEQEPIFRKREFNKEIKSLLSQLESLDLPGYCPLREPHRTLNFLADHRLFPALQSVVSQAVDKLRGAHCRDGRPLFPTSLEPTSDLPPLGSEPAKPTNGGQPYASPRPTVSSPKMLQRKRKDRGGSPSMSSAQVATRFKLKSPCSSSRFTKKKPLPSISSKSSMSHFSNRLYEELADFLTQQAASLVIRKYEFEKDLSKQLGFFSFPITHVLRDLSLGLKKVKGSRIHLSSETHRSCLLRKLEESKRARQASRLSTSHCSTETPSVQQEPATHTAQDQATEPCRSLYTNLPASRQLSPLEPKLYMSACTGMGSSPPKSKDMDNEGRDKAEIEDEDEDEFKDEDQDEDKDEDGV

SEQ ID NO: 11161 - protein, 279 aa, Homo sapiens
MAALGRPFSGLPLSGGSDFLQPPQPAFPGRAFPPGADGAELAPRPGPRAVPSSPAGSAARGRVSVHCKKKHKREEEEDDDCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 11162 - protein, 204 aa, Homo sapiens
MAALGRPFSGLPLSGGSDFLQPPQPAFPGRAFPPGADGAELAPRPGPRAVPSSPAGSAARGRVSVHCKKKHKREEEEDDEIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 11163 - protein, 147 aa, Homo sapiens
MDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 11164 - protein, 261 aa, Homo sapiens
MAALGRPFSGLPLSGGSDFLQPPQPAFPGRAFPPGADGAELAPRPGPRAVPSSPAGSAARGRCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 11165 - protein, 179 aa, Homo sapiens
MQDGRKGGAYAGKMEATTAGVGRLEEEALRRKERLKALREKTGRKDKEDGEPKTKHLREEEEEGEKHRELRLRNYVPEDEDLKKRRVPQAKPVAVEEKVKEQLEAAKPEPVIEEVDLANLAPRKPDWDLKRDVAKKLEKLKKRTQRAIAELIRERLKGQEDSLASAVDAATEQKTCDSD

SEQ ID NO: 11166 - protein, 179 aa, Homo sapiens; identical to SEQ ID NO: 11165

SEQ ID NO: 11167 - protein, 102 aa, Homo sapiens
MQDGRKGGAYAGKMEATTAGVGRLEEEALRRKERLKALREKTGRKDKEDGEPKTKHLREEEEEGEKHRELRLRNYVPEDEDLKKRRVPQAKPVAVEEKVKEQ

SEQ ID NO: 11168 - protein, 166 aa, Homo sapiens
MEATTAGVGRLEEEALRRKERLKALREKTGRKDKEDGEPKTKHLREEEEEGEKHRELRLRNYVPEDEDLKKRRVPQAKPVAVEEKVKEQLEAAKPEPVIEEVDLANLAPRKPDWDLKRDVAKKLEKLKKRTQRAIAELIRERLKGQEDSLASAVDAATEQKTCDSD

SEQ ID NO: 11169 - protein, 630 aa, Homo sapiens
MEVKGQLISSPTFNAPAALFGEAAPQVKSERLRGLLDRQRTLQEALSLKLQELRKVCLQEAELTGQLPPECPLEPGERPQLVRRRPPTARAYPPPHPNQAHHSLCPAEELALEALEREVSVQQQIAAAARRLALAPDLSTEQRRRRRQVQADALRRLHELEEQLRDVRARLGLPVLPLPQPLPLSTGSVITTQGVCLGMRLAQLSQEDVVLHSESSSLSESGASHDNEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYGGCFY

SEQ ID NO: 11170 - protein, 661 aa, Homo sapiens
MEVKGQLISSPTFNAPAALFGEAAPQVKSERLRGLLDRQRTLQEALSLKLQELRKVCLQEAELTGQLPPECPLEPGERPQLVRRRPPTARAYPPPHPNQAHHSLCPAEELALEALEREVSVQQQIAAAARRLALAPDLSTEQRRRRRQVQADALRRLHELEEQLRDVRARLGLPVLPLPQPLPLSTGSVITTQGVCLGMRLAQLSQEDVVLHSESSSLSESGASHDNEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYYADFLYPPELSARLSDLTLEGEQSSSSDTQTPGTLV

SEQ ID NO: 11171 - protein, 618 aa, Homo sapiens
MEVKAALFGEAAPQVKSERLRGLLDRQRTLQEALSLKLQELRKVCLQEAELTGQLPPECPLEPGERPQLVRRRPPTARAYPPPHPNQAHHSLCPAEELALEALEREVSVQQQIAAAARRLALAPDLSTEQRRRRRQVQADALRRLHELEEQLRDVRARLGLPVLPLPQPLPLSTGSVITTQGVCLGMRLAQLSQEDVVLHSESSSLSESGASHDNEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYGGCFY

SEQ ID NO: 11172 - protein, 278 aa, Homo sapiens
MTDLNKHIKQAQTQRKQLLEESRELHREKLLVQAENRFFLEYLTNKTEEYTEQPEKVWNSYLQKSGEIERRRQESASRYAEQISVLKTALLQKENIQSSLKRKLQAMRDIAILKEKQEKEIQTLQEETKKVQAETASKTREVQAQLLQEKRLLEKQLSEPDRRLLGKRKRRELNMKAQALKLAAKRFIFEYSCGINRENQQFKKELLQLIEQAQKLTATQSHLENRKQQLQQEQWYLESLIQARQRLQGSHNQCLNRQDVPKTTPSLPQGTKSRINPK

SEQ ID NO: 11173 - protein, 440 aa, Homo sapiens
MGSRGQGSHSKKTRSMPVILSPQRTGSGATGGPAARAYSVAEAVKQFRAGPAGTGAGCSLQGCWAAPRPFEHRTNKLRELSTLAHCSRELQTQVPDASAHSLAVTLSELHSCRDLQDECLDSRFAEGPRRLLPPYHSLINNFVKPEKLTKVETRLKEKIVAEMTDLNKHIKQAQTQRKQLLEESRELHREKLLVQAENRFFLEYLTNKTEEYTEQPEKVWNSYLQKSGEIERRRQESASRYAEQISVLKTALLQKENIQSSLKRKLQAMRDIAILKEKQEKEIQTLQEETKKVQAETASKTREVQAQLLQEKRLLEKQLSEPDRRLLGKRKRRELNMKAQALKLAAKRFIFEYSCGINRENQQFKKELLQLIEQAQKLTATQSHLENRKQQLQQEQWYLESLIQARQRLQGSHNQCLNRQDVPKTTPSLPQGTKSRINPK

SEQ ID NO: 11174 - protein, 223 aa, Homo sapiens
MPKKFQGENTKSAAARARRAEAKAAADAKKQKELEDAYWKDDDKHVMRKEQRKEEKEKRRLDQLERKKETQRLLEEEDSKLKGGKAPRVATSSKVTRAQIEDTLRRDHQLREAPDTAEKAKSHLEVPLEENVNRRVLEEGSVEARTIEDAIAVLSVAEEAADRHPERRMRAAFTAFEEAQLPRLKQENPNMRLSQLKQLLKKEWLRSPDNPMNQRAVPFNAPK

SEQ ID NO: 11175 - protein, 223 aa, Homo sapiens; identical to SEQ ID NO: 11174

SEQ ID NO: 11176 - protein, 260 aa, Homo sapiens
MNNLNDPPNWNIRPNSRADGGDGSRWNYALLVPMLGLAAFRWIWSRESQKEVEKEREAYRRRTAAFQQDLEAKYHAMISENRRAVAQLSLELEKEQNRTASYREALISQGRKLVEEKKLLEQERAQVMQEKRQVQPLRSAYLSCLQREENWQRRARLLLKEFEAVLTERQNIYCSLFLPRSKRLEIEKSLLVRASVDPVAADLEMAAGLTDIFQHDTYCGDVWNTNKRQNGRLMWLYLKYWELVVELKKFKRVEEAILEK

SEQ ID NO: 11177 - protein, 69 aa, Homo sapiens
MNNLNDPPNWNIRPNSRADGGDGSRWNYALLVPMLGLAAFRWIWSRESQKEVEKEREAYRRRTAAFQQD

SEQ ID NO: 11178 - protein, 896 aa, Homo sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 11179 - protein, 1044 aa, Homo sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 11180 - protein, 142 aa, Homo sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEI

SEQ ID NO: 11181 - protein, 1062 aa, Homo sapiens
MPTTASCKTISLLKLLYSVSLQNYSPMMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGELLSAELDPFFFSSKANNSAKDEKIKSKDFLKTQDSGLL

SEQ ID NO: 11182 - protein, 163 aa, Homo sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQ

SEQ ID NO: 11183 - protein, 168 aa, Homo sapiens
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARF

SEQ ID NO: 11184 - protein, 1054 aa, Homo sapiens
MSFSLQNYSPMMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 11185 - protein, 715 aa, Homo sapiens
MAADESSQNTLRLQFKAMQEMQHKRLQKQMEKKREKELSLKSRADDQEEPLEVSDGLSLLHAGEPNSKNSFEKRVLEDEIEHLRNELRETVDENGRLYKLLKERDFEIKHLKKKIEEDRFAFTGTAGVAGDVVATKIVELSKKNRLLMAESEGAKTRVKQLTNRIQELERELQTALTRLSAKGATDAGAKPPRAQMGDRALLETPEVKALQDRLVATNLKMSDLRNQIQSVKQELRMAQKVLAREVGEDINVQQLLSSPGTWRGRAQQILVLQSKVQELEKQLGQARSQSAGTASDELSVYPDPRKLSAQEKNLLRIRSLEREKQEGLEKLASERDVLQRELEELKKKFEGMRSRNKLLSSEMKTLKSQMGTLVEKGRHDDELIDALMDQLKQLQEILGSLSLQEEKTRVSQHHLDQQLNSEAQRSNSLVAQLQAMVAEREAKVRQLEMEIGQLNVHYLRNKGVGEGSSGREVSPAYTQFLEDPGLTKSPASAGDHVGRLGSSRSVTSLGHTLVESALTRPSLPSPHRTSPRFSDSPEQKGWQAQVSEIKALWQAAEVERDRLTEFVTVLQKRVEESNSKLLESERKLQEERHRTVVLEQHLEKIRLEPGKASASQRAAPRTKTGLPTSNNRHNPTGSEKKDPSFAQLSDVPVESQMEELTTRLAIQVEENEMLKAALGSALRGKEEDFRMYHEILGQVKSVFLQALRQQKTGKQ

SEQ ID NO: 11186 - protein, 396 aa, Homo sapiens
MGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTEHEKKQKLETDAMFRLEHGEADRSTLKKALPTLSHIQEAQSAWKDDFALNSMLRRRFREKKKAIQEEEERDQALQAKASLTIPLVPETEDDRKLAALLKFHTLDSYEDKQKLKRTEIISRSWFPSAPGSASSSKVSGVLKKLAQSRRTALATSPITVGDLGIVRRRSRDVPESPQHAADTPKSGEPRVPEEAAQDRPMSPGDCPPETTETPKCSSPRGQEGSRQDKPLSPAGSSQEAADTPDTRHPCSLGSSLVADYSDSESE

SEQ ID NO: 11187 - protein, 159 aa, Homo sapiens
MGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTGERHPLTCLGALALSLRWGPQSPAEL

SEQ ID NO: 11188 - protein, 327 aa, Homo sapiens
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTVCSDLITIHISLL

SEQ ID NO: 11189 - protein, 964 aa, Homo sapiens
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLEVSADPTATLTAAEERKEKVPSPHLSHLVVLTSGDTLYGLAERVVATESLVFLAEQFEFLQPHLDAVMPAVKKPFLQQFYSQTVSTASELRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 11190 - protein, 413 aa, Homo sapiens
MDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVDGVSLCCLGWSTVAHLHSLQAPPPGFKPFSCLSLPRSWDYRRPPPRPANFLYFLFFSRDGVSPC

SEQ ID NO: 11191 - protein, 684 aa, Homo sapiens
MQKIKSLMTRQGLKSPQESLSDLGAIESLRVPGKHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLEVSADPTATLTAAEERKEKVPSPHLSHLVVLTSGDTLYGLAERVVATESLVFLAEQFEFLQPHLDAVMPAVKKPFLQQFYSQTVSTASELRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 11192 - protein, 593 aa, Homo sapiens
MLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLEVSADPTATLTAAEERKEKVPSPHLSHLVVLTSGDTLYGLAERVVATESLVFLAEQFEFLQPHLDAVMPAVKKPFLQQFYSQSQPPVNYGNQFTGL

SEQ ID NO: 11193 - protein, 934 aa, Homo sapiens
MLTLEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLEVSADPTATLTAAEERKEKVPSPHLSHLVVLTSGDTLYGLAERVVATESLVFLAEQFEFLQPHLDAVMPAVKKPFLQQFYSQTVSTASELRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 11194 - protein, 665 aa, Homo sapiens
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKLLPLMTEQLQWMPFVNIKLHEPFVKFIYWSLRQLDAGAQHSTMTSTLRRLGEDIFKGVVTKGIQDNSPQHSVENKPKTAAFFKSSNLPLRFLSTLIVLKTVTQADYLAQAFDSLCLDLKTEEGKTLFLEYQAVPVILSHLRISSKGLLSNVIDSLLQMTVESKSLQPFLEACSNSLFFRTCSVLLRAPKLDLQILEKLSIILQKLSKIKSNKKLFELFTIHLMLQEIQRTTNPEHAFLCINLNSTLFNLGLTKCNSLVSSASP

SEQ ID NO: 11195 - protein, 577 aa, Homo sapiens
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKLLPLMTEQLQWMPFVNIKLHEPFVKFIYWSLRQLDAGAQHSTMTSTLRRLGEDIFKGVVTKGIQDNSPQHSVENKPKTAAFFKSSNLPLRFLSTLIVLKTVTQADYLAQAFDSLCLDLKTEEGKTLFLEYQAVPVILSHLRISSKGLLSNVIDSLLQMTVESRVIRSSLNFLRFI

SEQ ID NO: 11196 - protein, 163 aa, Homo sapiens
MGDECSNPDLLAEPGSSPPWDHGNQRQEAANESNTRVPRVLKAHLGPETAQPTKRSKRNRWRRQSCQGPSPARSGQFLGSADLGLQRGVLKSAARTCLSEISNSTRASPESAQSTDPGRAARPRTRTLPTPHSFKIGEEAEEMKKKKERKRRKERKKERNFKK

SEQ ID NO: 11197 - protein, 17 aa, Homo sapiens
MGDECSNPDLLAEPGSS

SEQ ID NO: 11198 - protein, 875 aa, Homo sapiens
MQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKKTSHNLKLLQEALMPVSALDLGGSLQFILDLRQKWNDMKPQFQQLNDEVQYIMKESEELTGRGAPVKEKSQQLKDLIHFHQKQKERIQDYEDILYKVVQFHQVKEELGRLIKSRELEFVEQPKELGDAHDVQIHLRCSQEKQARVDHLHRLALSLGVDIISSVQRPHCSNVSAKNLQQQLELLEEDSMKWRAKAEEYGRTLSRSVEYCAMRDEINELKDSFKDIKKKFNNLKFNYTKKNEKSRNLKALKYQIQQVDMYAEKMQALKRKMEKVSNKTSDSFLNYPSDKVNVLLEVMKDLQKHVDDFDKVVTDYKKNLDLTEHFQEVIEECHFWYEDASATVVRVGKYSTECKTKEAVKILHQQFNKFIAPSVPQQEERIQEATDLAQHLYGLEEGQKYIEKIVTKHKEVLESVTELCESLTELEEKLKQGDVLKMNPNLEDFHYDYIDLLKEPAKNKQTIFNEERNKGQVQVADLLGINGTGEERLPQDLKVSTDKEGGVQDLLLPEDMLSGEEYECVSPDDISLPPLPGSPESPLAPSDMEVEEPVSSSLSLHISSYGVQAGTSSPGDAQESVLPPPVAFADACNDKRETFSSHFERPYLQFKAEPPLTSRGFVEKSTALHRISAEHPESMMSEVHERALQQHPQAQGGLLETREKMHADNNFTKTQDRLHASSDAFSGLRFQSGTSRGYQRQMVPREEIKSTSAKSSVVSLADQAPNFSRLLSNVTVMEGSPVTLEVEVTGFPEPTLTWWVAYNDKP

SEQ ID NO: 11199 - protein, 894 aa, Homo sapiens
RSQVLQTYVAFLKSSEEVEMQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKKTSHNLKLLQEALMPVSALDLGGSLQFILDLRQKWNDMKPQFQQLNDEVQYIMKESEELTGRGAPVKEKSQQLKDLIHFHQKQKERIQDYEDILYKVVQFHQVKEELGRLIKSRELEFVEQPKELGDAHDVQIHLRCSQEKQARVDHLHRLALSLGVDIISSVQRPHCSNVSAKNLQQQLELLEEDSMKWRAKAEEYGRTLSRSVEYCAMRDEINELKDSFKDIKKKFNNLKFNYTKKNEKSRNLKALKYQIQQVDMYAEKMQALKRKMEKVSNKTSDSFLNYPSDKVNVLLEVMKDLQKHVDDFDKVVTDYKKNLDLTEHFQEVIEECHFWYEDASATVVRVGKYSTECKTKEAVKILHQQFNKFIAPSVPQQEERIQEATDLAQHLYGLEEGQKYIEKIVTKHKEVLESVTELCESLTELEEKLKQGDVLKMNPNLEDFHYDYIDLLKEPAKNKQTIFNEERNKGQVQVADLLGINGTGEERLPQDLKVSTDKEGGVQDLLLPEDMLSGEEYECVSPDDISLPPLPGSPESPLAPSDMEVEEPVSSSLSLHISSYGVQAGTSSPGDAQESVLPPPVAFADACNDKRETFSSHFERPYLQFKAEPPLTSRGFVEKSTALHRISAEHPESMMSEVHERALQQHPQAQGGLLETREKMHADNNFTKTQDRLHASSDAFSGLRFQSGTSRGYQRQMVPREEIKSTSAKSSVVSLADQAPNFSRLLSNVTVMEGSPVTLEVEVTGFPEPTLTWWVAYNDKP

SEQ ID NO: 11200 - protein, 1530 aa, Homo sapiens
MSSQGSPSVALSTTTVSSVAVQAGDSKIVIAVIKCGKWVQLQLAESQPNLLEIGSSQDETKKLLHDHELLLAKLKALEDRVWELLQEADKTAEENKDQSQVYDAMAETLGEAWAALVSMLERRTELLRLTSEFFENALEFAIKIDQAEDFLQNTHEFESAESLKSLLQLHEHHTKELLERSLALLNKSQQLTDFIEKFKCEGPNVNPELTQGAHSSCLKVDRLLELLQDRRRQLDKYLKQQWQELSQVLQICQWDQQENQVTCWFQKTIRNLQEQSLGSSLSDNEDRIHKQEELIIKAKEWNSAVEKLKSEALRILLSKDYVEKEHLQLSHQKLSQLQEEFGQLMVERNTWLKKANEFFNSANKAFDVLGRVEAYLKLLKSEGLSLAVLAVRHEELHRKIKDCTTDALQKGQTLISQVDSCSSQVSGIHEMMGCIKRRVDHLTEQCSAHKEYALKKQQLTASVEGYLRKVEMSIQKISPVLSNAMDVGSTRSESEKILNKYLELDIQAKETSHELEAAAKTMMEKNEFVSDEMVSLSSKARWLAEELNLFGQSIDYRSQVLQTYVAFLKSSEEVEMQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKKTSHNLKLLQEALMPVSALDLGGSLQFILDLRQKWNDMKPQFQQLNDEVQYIMKESEELTGRGAPVKEKSQQLKDLIHFHQKQKERIQDYEDILYKVVQFHQVKEELGRLIKSRELEFVEQPKELGDAHDVQIHLRCSQEKQARVDHLHRLALSLGVDIISSVQRPHCSNVSAKNLQQQLELLEEDSMKWRAKAEEYGRTLSRSVEYCAMRDEINELKDSFKDIKKKFNNLKFNYTKKNEKSRNLKALKYQIQQVDMYAEKMQALKRKMEKVSNKTSDSFLNYPSDKVNVLLEVMKDLQKHVDDFDKVVTDYKKNLDLTEHFQEVIEECHFWYEDASATVVRVGKYSTECKTKEAVKILHQQFNKFIAPSVPQQEERIQEATDLAQHLYGLEEGQKYIEKIVTKHKEVLESVTELCESLTELEEKLKQGDVLKMNPNLEDFHYDYIDLLKEPAKNKQTIFNEERNKGQVQVADLLGINGTGEERLPQDLKVSTDKEGGVQDLLLPEDMLSGEEYECVSPDDISLPPLPGSPESPLAPSDMEVEEPVSSSLSLHISSYGVQAGTSSPGDAQESVLPPPVAFADACNDKRETFSSHFERPYLQFKAEPPLTSRGFVEKSTALHRISAEHPESMMSEVHERALQQHPQAQGGLLETREKMHADNNFTKTQDRLHASSDAFSGLRFQSGTSRGYQRQMVPREEIKSTSAKSSVVSLADQAPNFSRLLSNVTVMEGSPVTLEVEVTGFPEPTLTWYKKGQKLSADGHLQVLHKETRHSVFIPKVCKADAGLYVARAQNSSGALSSNVILHVTGNCRLPITRVNWITLCVVYVSVSLMYWLLTQ

SEQ ID NO: 11201 - protein, 750 aa, Homo sapiens
MAQASRSGSLPPLVIVPPLRAQPGGTGEEQWERSRTGGLRWEVHCWPSGTSGGTPWWPTPADVSEDYEADAAAWRRGPAGGGPIPPALQRLRAVLLRLHREREQLLQARDCAYHLQSAVRLMKTLSPGSPSGGPSPLPQWCRDLQLHPSQGAVLRIGPGETLEPLLLARPIGLAAQCLEAVIEMQLRALGREPASPGLSSQLAELLFALPAYHTLQRKALSHVPGAARPFPTSRVLRLLTGERGCQVASRLDEALQGSALRDQLRRRCQEEGDLLPGLLGLVGGVAGSASCGLGLGGAGALWSQYWTLLWAACAQSLDLNLGPWRDPRATAQQLSQALGQASLPQECEKELASLCHRLLHQSLIWSWDQGFCQALGSALGGQSSLPTSSGTAELLQQLFPPLLDALREPRLRRIFCQPADPAPVALGLCTLQTTLLWFLGRAQQYLAAWDPASFLLLIQKDLPPLLHEAEALYSLASEESLALEVEQQLGLEIQKLTAQIQLLPEESLSVFSQECHKQAMQGFKLYMPRGRYWRLRLCPEPPSAPSEYAGLVVRTVLEPVLQGLQGLPPQAQAPALGQALTAIVGAWLDHILTHGIRFSLQGALQLKQDFGVVRELLEEEQWSLSPDLRQTLLMLSIFQQLDGALLCLLQQPLPKSQVHRRPPCCCACQEVQTTKLPSSCLNSLESLEPPLQPGTSPAQTGQLQSTLGGRGPSPEGYLVGNQQAWLALRQHQRPRWHLPFFSCLGTSPES

SEQ ID NO: 11202 - protein, 743 aa, Homo sapiens
MAQASRSGSLPPLVIVPPLRAQPGGTGEEQWERSRTGGLRWEVHCWPSGTSGGTPWWPTPADVSEDYEADAAAWRRGPAGGGPIPPALQRLRAVLLRLHREREQLLQARDCAYHLQSAVRLMKTLSPGSPSGGPSPLPQWCRDLQLHPSQGAVLRIGPGETLEPLLLARPIGLAAQCLEAVIEMQLRALGREPASPGLSSQLAELLFALPAYHTLQRKALSHVPGAARPFPTSRVLRLLTGERGCQVASRLDEALQGSALRDQLRRRCQEEGDLLPGLLGLVGGVAGSASCGLGLGGAGALWSQYWTLLWAACAQSLDLNLGPWRDPRATAQQLSQALGQASLPQECEKELASLCHRLLHQSLIWSWDQGFCQALGSALGGQSSLPTSSGTAELLQQLFPPLLDALREPRLRRIFCQPAGLCTLQTTLLWFLGRAQQYLAAWDPASFLLLIQKDLPPLLHEAEALYSLASEESLALEVEQQLGLEIQKLTAQIQLLPEESLSVFSQECHKQAMQGFKLYMPRGRYWRLRLCPEPPSAPSEYAGLVVRTVLEPVLQGLQGLPPQAQAPALGQALTAIVGAWLDHILTHGIRFSLQGALQLKQDFGVVRELLEEEQWSLSPDLRQTLLMLSIFQQLDGALLCLLQQPLPKSQVHRRPPCCCACQEVQTTKLPSSCLNSLESLEPPLQPGTSPAQTGQLQSTLGGRGPSPEGYLVGNQQAWLALRQHQRPRWHLPFFSCLGTSPES

SEQ ID NO: 11203 - protein, 221 aa, Homo sapiens
MASWGGEKRGGAGGSPKPAVYATRKTPSVGSQEDQWYLDYPGDQWSLGFSYSWWKNSVGSESKHGEGALDQLQHDVRLEDLGELHRAARSGDVPGVEHVLAPGDTGVDKRDRKKSIQQLVPEYKEKQTPESLPQNNNPAAPSQAEGGEGGVACGTVEQMTWLCSLPHAVGGGDGDHSSTGAVGGHPRGPGEYCHLHEQRVHHHIFARGKRKGKNHVSNVVR

SEQ ID NO: 11204 - protein, 918 aa, Homo sapiens
  MOD_RES (1)..(1): Any amino acid
XKGCENKQPQVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKVVMREFQQEWTDLLKQQPTSEATSRCHINLDETQDSKKKLGQIRSEIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKVSYLFSFGVQISDRILVCYLVK

SEQ ID NO: 11205 - protein, 571 aa, Homo sapiens
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDR

SEQ ID NO: 11206 - protein, 726 aa, Homo sapiens
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRFLIGIRKKRISFMKIACCRKKLPC

SEQ ID NO: 11207 - protein, 1427 aa, Homo sapiens
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKMQQKLQNDLTAEVAGSSQTGLHRIPQCSSFSSSSLHLLLCSICQPFFLILQLLLNMNLDPI

SEQ ID NO: 11208 - protein, 226 aa, Homo sapiens
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEGNKEA

SEQ ID NO: 11209 - protein, 1425 aa, Homo sapiens
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKMQQKLQNDLTAEVAAATKYEPGSYIASPLGFTHKENLNQDPVLEVTKEYAQILRRKYIL

SEQ ID NO: 11210 - protein, 327 aa, Homo sapiens
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEISLPPDSDRTSEVYLHEELQQDMQKFKNEVNTLEEEFLALKKEDVQLHKD

SEQ ID NO: 11211 - protein, 260 aa, Homo sapiens
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQDKAIFKTCSPTEKT

SEQ ID NO: 11212 - protein, 1427 aa, Homo sapiens; identical to SEQ ID NO: 11207

SEQ ID NO: 11213 - protein, 725 aa, Homo sapiens [sequence omitted]

SEQ ID NO: 11214 - protein, 1154 aa, Homo sapiens
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKVVMREFQQEWTDLLKQQPTSEATSRCHINLDETQDSKKKLGQIRSEIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKVSYLFSFGVQISDRILVCYLVK

SEQ ID NO: 11215 - protein, 226 aa, Homo sapiens
MVSWGGEKRGGAEGSPKPAVYATRKTGSVRSQEDQWYLGYPGDQWSSGFSYSWWKNSVGSESKHGEGALDQPQHDVRLEDLGELHRAARSGDVPGVEHVLVPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEGNKEA

SEQ ID NO: 11216 - protein, 1237 aa, Homo sapiens
MVSWGGEKRGGAEGSPKPAVYATRKTGSVRSQEDQWYLGYPGDQWSSGFSYSWWKNSVGSESKHGEGALDQPQHDVRLEDLGELHRAARSGDVPGVEHVLVPGDTGVDKRDRKKSIQQLVPEYKEKQTPESLPQNNNPDWHPTNLTLSDETCQRSKNLKVDDKCPSVSPSMPENQSATKELGQMNLTEREKMDTGVKTSQEPEMAKDCDREDIPIYPVLPHVQKSEEMRIEQGKLEWKNQLKLVINELKQRFGEIYEKYKIPACPEEEPLLDNSTRGTDVKDIPFNLTNNIPGCEEEDASEISVSVVFETFPEQKEPSLKNIIHSYYHPYSGSQEHVCQSSSKLHLHENKLDCDNDNKPGIGHIFSTDKNFHNDASTKKARNPEVVTVEMKEDQEFDLQMTKNMNQNSDSGSTNNYKSLKPKLENLSSLPPDSDRTSEVYLHEELQQDMQKFKNEVNTLEEEFLALKKENVQLHKEVEEEMEKHRSNSTELSGTLTDGTTVGNDDDGLNQQIPRKENGEHDRLALKQENEEKRNADMLYNKDSEQLRIKEEECGKVVETKQQLKWNLRRLVKELRTVVQERNDAQKQLSEEQDARILQDQILTSKQKELEMAQKKRNPEISHRHQKEKDLFHENCMLQEEIALLRLEIDTIKNQNKQKEKKYFEDIEVVKEKNDNLQKIIKRNEETLTETILQYSGQLNNLTAENKMLNSELENGKENQERLEIEMESYRCRLAAAVHDCDQSQTARDLKLDFQRTRQEWVRLHDKMKVDMSGLQAKNEILSEKLSNAESKINSLQIQLHNTRDALGRESLILERVQRDLSQTQCQKKETEQMYQSKLKKYIAKQESVEERLSQLQSENMLLRQQLDDVHKKANSQEKTISTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGEAEWHKLLIEERARKEIEEKLNEAILTLQKQAAVSHEQLAQLREDNTTSIKTQMELTVIDLESEISRIKTSQADFNKTKLERYKELYLEEVKVRESLSNELSRTNEMIAEVSTQLTVEKEQTRSRSLFTAYATRPVLESPCVGNLNDSEGLNRKHIPRKKRSALKDMESYLLKMQQKLQNDLTAEVAGSSQTGLHRIPQCSSFSSSSLHLLLCSICQPFFLILQLLLNMNLDPI

SEQ ID NO: 11217 - protein, 955 aa, Homo sapiens
MEDSSTDTEKEEEEEKDEKDQEPIYAIVPTINIQDERFVDLSETPAFIFLHELHAMGKLPGTRMAALKAKYTLLHDAVMSTQESEVQLLQNAKRFTEQIQQQQFHLQQADNFPEAFSTEVSKMREQLLKYQNEYNAVKEREFHNQYRLNSLKEEKIIIVKEFEKITKPGEMEKKMKILRESTEELRKEIMQKKLEIKNLREDLASKQKQLLKEQKELEELLGHQVVLKDEVAHHQTIPVQIGKEIEKITRKKVEMEKKKIVLEQEVKTLNDSLKKVENKVSAIVDEKENVIKEVEGKRALLEIKEREHNQLVKLLELARENEATSLTERGILDLNLRNSLIDKQNYHDELSRKQREKERDFRNLRKMELLLKVSWDALRQTQALHQRLLLEMEAIPKDDSTLSERRRELHKEVEVAKRNLAQQKIISEMESKLVEQQLAEENKLLKEQENMKELVVNLLRMTQIKIDEKEQKSKDFLKAQQKYTNIVKEMKAKDLEIRIHKKKKCEIYRRLREFAKLYDTIRNERNKFVNLLHKAHQKVNEIKERHKMSLNELEILRNSAVSQERKLQNSMLKHANNVTIRESMQNDVRKIVSKLQEMKEKKEAQLNNIDRLANTITMIEEEMVQLRKRYEKAVQHRNESGVQLIEREEEICIFYEKINIQEKMKLNGEIEIHLLEEKIQFLKMKIAEKQRQICVTQKLLPAKRSLDADLAVLQIQFSQCTDRIKDLEKQFVKPDGENRARFLPGKDLTEKEMIQKLDKLELQLAKKEEKLLEKDFIYEQVSRLTDRLCSKTQGCKQDTLLLAKKMNGYQRRIKNATEKMMALVAELSMKQALTIELQKEVREKEDFIFTCNSRIEKGLPLNKEIEKEWLKVLRDEEMHALAIAEKSQEFLEADNRQLPNGVYTTAEQRPNAYIPEADATLPLPKPYGALAPFKPSEPGANMRHIRKPVIKPVEI

SEQ ID NO: 11218 - protein, 170 aa, Homo sapiens
MEDSSTDTEKEEEEEKDEKDQEPIYAIVPTINIQDERFVDLSETPAFIFLHELHAMGKLPGTRMAALKAKYTLLHDAVMSTQESEVQLLQNAKRFTEQIQQQQFHLQQADNFPEAFSTEVSKMREQLLKYQNEYNAVKEREFHNQYRLNSLKEEKIIIVKEFEKITKPGV

SEQ ID NO: 11219 - protein, 669 aa, Homo sapiens
MEKKKIVLEQEVKTLNDSLKKVENKVSAIVDEKENVIKEVEGKRALLEIKEREHNQLVKLLELARENEATSLTERGILDLNLRNSLIDKQNYHDELSRKQREKERDFRNLRKMELLLKVSWDALRQTQALHQRLLLEKIISEMESKLVEQQLAEENKLLKEQENMKELVVNLLRMTQIKIDEKEQKSKDFLKAQQKYTNIVKEMKAKDLEIRIHKKKKCEIYRRLREFAKLYDTIRNERNKFVNLLHKAHQKVNEIKERHKMSLNELEILRNSAVSQERKLQNSMLKHANNVTIRESMQNDVRKIVSKLQEMKEKKEAQLNNIDRLANTITMIEEEMVQLRKRYEKAVQHRNESGVQLIEREEEICIFYEKINIQEKMKLNGEIEIHLLEEKIQFLKMKIAEKQRQICVTQKLLPAKRSLDADLAVLQIQFSQCTDRIKDLEKQFVKPDGENRARFLPGKDLTEKEMIQKLDKLELQLAKKEEKLLEKDFIYEQVSRLTDRLCSKTQGCKQDTLLLAKKMNGYQRRIKNATEKMMALVAELSMKQALTIELQKEVREKEDFIFTCNSRIEKGLPLNKEIEKEWLKVLRDEEMHALAIAEKSQEFLEADNRQLPNGVYTTAEQRPNAYIPEADATLPLPKPYGALAPFKPSEPGANMRHIRKPVIKPVEI

SEQ ID NO: 11220 - protein, 92 aa, Homo sapiens
MDELLRERDILNKNMLKAVNATQKQTDLVKLHEQAKRNLEGEIQNYKDEAQKQRKIIFHLEKERDRYINQASDLTQKADSVRMPWPLDKGKW

SEQ ID NO: 11221 - protein, 92 aa, Homo sapiens; identical to SEQ ID NO: 11220

SEQ ID NO: 11222 - protein, 872 aa, Homo sapiens
MAEEKGGKQVLEESAFEEMERDFQGVLHELSGDKSLEKFRIEYERLHAVMKKSYDNEKRLMAKCRELNAEIVVNSAKVATALKLSQDDQTTIASLKKEIEKAWKMVDSAYDKEQKAKETILALKEEIVNLTKLVEQGSGLSMDQHSNIRDLLRFKEEVTKERDQLLSEVVKLRESLAQTTEQQQETERSKEEAEHAISQFQQEIQQRQNEASREFRKKEKLEKELKQIQADMDSRQTEIKALQQYVQKSKEELQKLEQQLKEQKILNERAAKELEQFQMRNAKLQQENEQHSLVCEQLSQENQQKALELKAKEEEVHQMRLDIGKLNKIREQIHKKLHHTEDQKAEVEQHKETLKNQIVGLEREVEASKKQAELDRKAMDELLRERDILNKNMLKAVNATQKQTDLVKLHEQAKRNLEGEIQNYKDEAQKQRKIIFHLEKERDRYINQASDLTQKVLMNMEDIKVRETQIFDYRKKIAESEIKLKQQQNLYEAVRSDRNLYSKNLVEAQDEITDMKRKLKIMIHQVDELKEDISAKESALVKLHLEQQRIEKEKETLKAELQKLRQQALETKHFIEKQEAEERKLLRIIAEADGERLRQKKELDQVISERDILGSQLVRRNDELALLYEKIKIQQSVLNKGESQYNQRLEDMRILRLEIKKLRREKGILARSMANVEELRQEFFHMQRELLKERTRCRALEEELENPLNVHRWRKLEASDPNAYELIQKIHTLQKRLISKTEEVVEKELLLQEKEKLYMELKHVLARQPGPEAAEQLKLYRRTLHDKKQQLKVLSSELNMYEVQSKEYKYEVEKLTNELQNLKKKYLAQKRKEQLQKNKDTAPMDNTFLMVKPNGPGFTGGGFPLRSTKMTF

SEQ ID NO: 11223 - protein, 591 aa, Homo sapiens
MCAASASPDNLVFHMKNEMRNIKYKPVDYQQLRALTEAKKLASASAKLKIRKAMLTSKLSKEQTLIKQHKQVWWQEYQRLNEVRCKMESEIKSLLNEENIGNECLCDLTNFEQELSEQQCTYLKNVINPIQQLRADLKYRQHHTLQHSHPHIEFNSMKVLEEVDFVKKQLKTVFERLRLEQQRIENDLSDWSIKILDHSLEEKTNPLSELPIELESLECPYPDLKSSILSEFYKFTQKYQKKLQDFNLQLEDIYRNCQLSEEDHWIYQAILDQYPGDLFGRRTLYLDMLQRYFPHKSRHDLVEHEKYCDQYRFAIEQQNILISNWNKNKKDFIQKAVLTLTEACATHEMESMLAKDKKKQQELCADLKAKVRQWRAHQEEVARLEMEISARRREKEEEKEKLWKKKELLQRAEKKKKIKKYWAKKKQKWQEMEMRDLQRLEELKKLIAEQSLKDRERVKYRQELLERRLMEKKEVALQEAHEDKERARRLEALRKQVAVVAQFDPVRMMSDTMASKARMGIEIEEEFILQKPLFTLNTYNEQQIISDPRLRFELALREAGLHRTLYAKEILPKISPQKPPRKDMESTVFKI

SEQ ID NO: 11224 - protein, 264 aa, Homo sapiens
MNVFVTLQILVDFVKKQLKTVFERLRLEQQRIENDLSDWSIKILDHSLEEKTNPLSELPIELESLECPYPDLKSSILSEFYKFTQKYQKKLQDFNLQLEDIYRNCQLSEEDHWIYQAILDQYPGDLFGRRTLYLDMLQRYFPHKSRHDLVEHEKYCDQYRFAIEQQNILISNWNKNKKDFIQKAVLTLTEACATHEMESMLAKDKKKQQELCADLKAKVRQWRAHQEEVARLEMEISARRREKEEEKEKLWKKKELLQRAEKKK

SEQ ID NO: 11225 - protein, 299 aa, Homo sapiens
MESEIKSLLNEENIGNECLCDLTNFEQELSEQQCTYLKNVINPIQQLRADLKYRQHHTLQHSHPHIEFNSMKVLEEVDFVKKQLKTVFERLRLEQQRIENDLSDWSIKILDHSLEEKTNPLSELPIELESLECPYPDLKSSILSEFYKFTQKYQKKLQDFNLQLEDIYRNCQLSEEDHWIYQAILDQYPGDLFGRRTLYLDMLQRYFPHKSRHDLVEHEKYCDQYRFAIEQQNILISNWNKNKKDFIQKAVLTLTEACATHEMESMLAKDKKKQQELCADLKAKSQVCLYQQHENGLIQ

SEQ ID NO: 11226 - protein, 453 aa, Homo sapiens
MEIHHFLLKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 11227 - protein, 86 aa, Homo sapiens
MANQLRERHQSLKKKYRELIDGDPSLPPEKRKQANLAQLLRDSQDRNKHLGEEIKELQQRLGEVQGDNKGRLRSKKKMKVVPLLRR

SEQ ID NO: 11228 - protein, 529 aa, Homo sapiens
MEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 11229 - protein, 529 aa, Homo sapiens
MVVIVVVIIIIIARAATWDSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 11230 - protein, 748 aa, Homo sapiens
MSLHEASEKAQVLNDQLTKKCSELSCMLQTVTMEKARIIADHQAILQVEQKMMTQTFQEQNLLLDAAHASITNELQTVQNEKTQLQAHLDHLILEHNQCIQKAQDAEKRTAVQKELLESTIARLRGELEASMQEKKSLLEEKERFQREVNKTEKEIVQERCNLEKELAKNKVDINTLTHNLQTLEEENKHLADQMASLELQQVTSDYHGLAQQKVEKITESKNKLAYENGKLQIKVKQLEEQVQSFTDTSLQNDHLRKMNKYLQTKYAQVKSILERSKEELSRTVKCRNAALKESQKLKEDLEAVEDRENKKVGNFQRQLAEAKEDNCKVTIMLENVLASHSKMQGALEKVQIELGRRDSEIAGLKKERDLNQQRVQKLEAEVDQWQARMLVMEDQHNSEIESLQKALGVAREDNRKLAMSLEQALQTNNHLQTKLDHIQEQLESKELERQNLETFKDRMTEESKVEAELHAERIEALRKQFQTERETTKKVAQREVAELKKALDEANFRSVEVSRTNRELRQKLAELEKILESNKEKIKNQKTQIKLHLSAKANNAQNIERMKQIEKELKQMELIKDQYQKKNYEQSLSIQRFVCEMTNLQKEMQMLAKSQYDASVRNKQQELHLEAERKIRQELENRCQELEETVRHLKKCKEATENTLKEASVESEQITANLEEAHRWFKHRFDGLQLELTKNRLQRPSGEDRWQEKDQDVKHDVMSNQSVLHRWERKQNLRPMPKKYHSEVQRK

SEQ ID NO: 11231 - protein, 1101 aa, Homo sapiens
MDCKVHMETTVSRPVLSPTHINATASETFTVLQQRMRIVEEQTSSLRDDLIMLDFGEKRGYLEAPDCLEDLDSQKVISPIQNEAICAGKTDILWKNCEFLVNRMCRLESLMQSLKMNIFRLQTEKDLNPQKTAFLKDRLNAIQEEHSKDLKLLHLEVMNLRQQLRAVKEEEDKAQDEVQRLTATLKIASQTKKNAAIIEEELKTTKRKMNLKIQELRRQLAQEKYLRESLEKSASAMLLKIQEMGSTVEVERKQVHILQQNCIALRDSIQSAQELLAQEQKKKEELEIATSQLKSDLTSRDDLISKLVEENKNLQISFNKEHEENAYLRSEIMSLHEASEKAQVLNDQLTKKCSELSCMLQTVTMEKARIIADHQAILQVEQKMMTQTFQEQNLLLDAAHASITNELQTVQNEKTQLQAHLDHLILEHNQCIQKAQDAEKRTAVQKELLESTIARLRGELEASMQEKKSLLEEKERFQREVNKTEKEIVQERCNLEKELAKNKVDINTLTHNLQTLEEENKHLADQMASLELQQVTSDYHGLAQQKVEKITESKNKLAYENGKLQIKVKQLEEQVQSFTDTSLQNDHLRKMNKYLQTKYAQANSELSAKRVHLQQADAHLKEVKSILERSKEELSRTVKCRNAALKESQKLKEDLEAVEDRENKKVGNFQRQLAEAKEDNCKVTIMLENVLASHSKMQGALEKVQIELGRRDSEIAGLKKERDLNQQRVQKLEAEVDQWQARMLVMEDQHNSEIESLQKALGVAREDNRKLAMSLEQALQTNNHLQTKLDHIQEQLESKELERQNLETFKDRMTEESKVEAELHAERIEALRKQFQTERETTKKVAQREVAELKKALDEANFRSVEVSRTNRELRQKLAELEKILESNKEKIKNQKTQIKLHLSAKANNAQNIERMKQIEKELKQMELIKDQYQKKNYEQSLSIQRFVCEMTNLQKEMQMLAKSQYDASVRNKQQELHLEAERKIRQELENRCQELEETVRHLKKCKEATENTLKEASVESEQITANLEEAHRWFKHRFDGLQLELTKNRLQRPSGEDRWQEKDQDVKHDVMSNQSVLHRWERKQNLRPMPKKYHSEVQRK

SEQ ID NO: 11232 - protein, 588 aa, Homo sapiens
MPLRKRKSPERTASSKSPEISRSHVNSIKERTSSVGLPSVIPNSTRRVSFAPNLPSMKTSQDIGDSRISLKTLLNAIKTMEGRLEGKIEILASRPLINDESPNFLKQDSVKSILERSKEELSRTVKCRNAALKESQKLKEDLEAVEDRENKKVGNFQRQLAEAKEDNCKVTIMLENVLASHSKMQGALEKVQIELGRRDSEIAGLKKERDLNQQRVQKLEAEVDQWQARMLVMEDQHNSEIESLQKALGVAREDNRKLAMSLEQALQTNNHLQTKLDHIQEQLESKELERQNLETFKDRMTEESKVEAELHAERIEALRKQFQTERETTKKVAQREVAELKKALDEANFRSVEVSRTNRELRQKLAELEKILESNKEKIKNQKTQIKLHLSAKANNAQNIERMKQIEKELKQMELIKDQYQKKNYEQSLSIQRFVCEMTNLQKEMQMLAKSQYDASVRNKQQELHLEAERKIRQELENRCQELEETVRHLKKCKEATENTLKEASVESEQITANLEEAHRWFKHRFDGLQLELTKNRLQRPSGEDRWQEKDQDVKHDVMSNQSVLHRWERKQNLRPMPKKYHSEVQRK

SEQ ID NO: 11233 - protein, 151 aa, Homo sapiens [sequence omitted]

SEQ ID NO: 11234 - protein, 128 aa, Homo sapiens
MCRLESLMQSLKMNIFRLQTEKDLNPQKTAFLKDRLNAIQEEHSKDLKLLHLEVMNLRQQLRAVKEEEDKAQDEVQRLTATLKIASQTKKNAAIIEEELKTTKRKMNLKIQELLEMTSFPSWLKKIRF

SEQ ID NO: 11235 - protein, 296 aa, Homo sapiens
MDCKVHMETTVSRPVLSPTHINATASETFTVLQQRMRIVEEQTSSLRDDLIMLDFGEKRGYLEAPDCLEDLDSQKVISPIQNEAICAGKTDILWKNCEFLVNRMCRLESLMQSLKMNIFRLQTEKDLNPQKTAFLKDRLNAIQEEHSKDLKLLHLEVMNLRQQLRAVKEEEDKAQDEVQRLTATLKIASQTKKNAAIIEEELKTTKRKMNLKIQELRRQLAQEKYLRESLEKSASAMLLKIQEMGSTVEVERKQVHILQQNCIALRDSIQSAQELLAQEQKKKKSWRLLLHSSNLI

SEQ ID NO: 11236 - protein, 595 aa, Homo sapiens
MTSPLCRAASANALPPQDQASTPSSRVKGREASGKPSHLRGKGTAQAWTPGRSKGGSFHRGAGKPSVHSQVAELHKKIQLLEGDRKAFFESSQWNIKKNQETISQLRKETKALELKLLDLLKGDEKVVQAVIREWKWEKPYLKNRTGQALEHLDHRLREKVKQQNALRHQVVLRQRRLEELQLQHSLRLLEMAEAQNRHTEVAKTMRNLENRLEKAQMKAQEAEHITSVYLQLKAYLMDESLNLENRLDSMEAEVVRTKHELEALHVVNQEALNARDIAKNQLQYLEETLVRERKKRERYISECKKRAEEKKLENERMERKTHREHLLLQSDDTIQDSLHAKEEELRQRWSMYQMEVIFGKVKDATGTDETHSLVRRFLAQGDTFAQLETLKSENEQTLVRLKQEKQQLQRELEDLKYSGEATLVSQQKLQAEAQERLKKEERRHAEAKDQLERALRAMQVAKDSLEHLASKLIHITVEDGRFAGKELDPQADNYVPNLLGLVEEKLLKLQAQLQGHDVQEMLCHIANREFLASLEGRLPEYNTRIALPLATSKDKFFDEESEEEDNEVVTRASLKIRSQKLIESHKKHRRSRRS

SEQ ID NO: 11237 - protein, 574 aa, Homo sapiens
LPPQDQASTPSSGKPSHLRGKGTAQAWTPGRSKGGSFHRGAGKPSVHSQVAELHKKIQLLEGDRKAFFESSQWNIKKNQETISQLRKETKALELKLLDLLKGDEKVVQAVIREWKWEKPYLKNRTGQALEHLDHRLREKVKQQNALRHQVVLRQRRLEELQLQHSLRLLEMAEAQNRHTEVAKTMRNLENRLEKAQMKAQEAEHITSVYLQLKAYLMDESLNLENRLDSMEAEVVRTKHELEALHVVNQEALNARDIAKNQLQYLEETLVRERKKRERYISECKKRAEEKKLENERMERKTHREHLLLQSDDTIQDSLHAKEEELRQRWSMYQMEVIFGKVKDATGTDETHSLVRRFLAQGDTFAQLETLKSENEQTLVRLKQEKQQLQRELEDLKYSGEATLVSQQKLQAEAQERLKKEERRHAEAKDQLERALRAMQVAKDSLEHLASKLIHITVEDGRFAGKELDPQADNYVPNLLGLVEEKLLKLQAQLQGHDVQEMLCHIANREFLASLEGRLPEYNTRIALPLATSKDKFFDEESEEEDNEVVTRASLKIRSQKLIESHKKHRRSRRS

SEQ ID NO: 11238 - protein, 541 aa, Homo sapiens
MHPPVAPCKKLRCPPTRSFTPTRGRSKEGDRKAFFESSQWNIKKNQETISQLRKETKALELKLLDLLKGDEKVVQAVIREWKWEKPYLKNRTGQALEHLDHRLREKVKQQNALRHQVVLRQRRLEELQLQHSLRLLEMAEAQNRHTEVAKTMRNLENRLEKAQMKAQEAEHITSVYLQLKAYLMDESLNLENRLDSMEAEVVRTKHELEALHVVNQEALNARDIAKNQLQYLEETLVRERKKRERYISECKKRAEEKKLENERMERKTHREHLLLQSDDTIQDSLHAKEEELRQRWSMYQMEVIFGKVKDATGTDETHSLVRRFLAQGDTFAQLETLKSENEQTLVRLKQEKQQLQRELEDLKYSGEATLVSQQKLQAEAQERLKKEERRHAEAKDQLERALRAMQVAKDSLEHLASKLIHITVEDGRFAGKELDPQADNYVPNLLGLVEEKLLKLQAQLQGHDVQEMLCHIANREFLASLEGRLPEYNTRIALPLATSKDKFFDEESEEEDNEVVTRASLKIRSQKLIESHKKHRRSRRS

SEQ ID NO: 11239 - protein, 254 aa, Homo sapiens
MDQSSEGCMKKISSVNLDKLINDFSQIEKKMVETNGKNNILDIQLEKSNCLLKVMQAKEVSIKEECATLHNIIKGLQQTIEYQQNLKGENEQLKISADLIKEKLKSHEQEYKNNIAKLVSEMKIKEEGYKKEISKLYQDMQRKVELNEEKHKELIEKKEMEISELNAKLRSQEKEKQNEIIKLQLEFDAKLARVQTKSKSYQDSTVLPQSIYRRKLQHFQEEKNKEIAILRNTIRDLEQRLSVGKDSHLKRRRF

SEQ ID NO: 11240 - protein, 210 aa, Homo sapiens
MPPKNKEKGKKSGAQKKKKNWGADVVAESRHRLVVLEKELLRDHLALRRDEARRAKASEDQLRQRLQGVEAELEGARSEGKAIYAEMSRQCHALQEDMQTRSKQLEEEVKGLRGQLEACQREAAAAREEAEQALGERDQALAQLRAHMADMEAKYEEILHDSLDRLLAKLRAIKQQWDGAALRLHARHKEQQRQFGLTPPGSLRPPAPSL

SEQ ID NO: 11241 - protein, 210 aa, Homo sapiens; identical to SEQ ID NO: 11240

SEQ ID NO: 11242 - protein, 674 aa, Homo sapiens
MSELADSGPSGASAPSQLRAVTLEDLGLLLAGGLASPEPLSLEELSERYESSHPTSTASVPEQDTAKHWNQLEQWVVELQAEVACLREHKQRCERATRSLLRELLQVRARVQLQGSELRQLQQEARPAAQAPEKEAPEFSGLQNQMQALDKRLVEVREALTRLRRRQVQQEAERRGAEQEAGLRLAKLTDLLQQEEQGREVACGALQKNQEDSSRRVDLEVARMQAQVTKLGEEVSLRFLKREAKLCGFLQKSFLALEKRMKASESSRLKLEGSLRGELESRWEKLRGLMEERLRALQGQHEVGPGGRRAEESHLLEQCQGLDAAVAQLTKFVQQNQASLNRVLLAEEKAWDAKGRLEESRAGELAAYVQENLEAAQLAGELARQEMHGELVLLREKSRALEASVAQLAGQLKELSGHLPALSSRLDLQEQMLGLRLSEAKTEWEGAERKSLEDLARWRKEVTEHLRGVREKVDGLPQQIESVSDKCLLHKSDSDLRISAEGKAREFKVGALRQELATLLSSVQLLKEDNPGRKIAEMQGKLATNQIMKLENCVQANKTIQNLRFNTEARLRTQEMATLWESVLRLWSEEGPRTPLGSWKALPSLVRPRVFIKDMAPGKVVPMNCWGVYQAVRWLRWKASLIKLRALRRPGGVLEKPHSQEQVQQLTPSLFIQK

SEQ ID NO: 11243 - protein, 522 aa, Homo sapiens
MQALDKRLVEVREALTRLRRRQVQQEAERRGAEQEAGLRLAKLTDLLQQEEQGREVACGALQKNQEDSSRRVDLEVARMQAQVTKLGEEVSLRFLKREAKLCGFLQKSFLALEKRMKASESSRLKLEGSLRGELESRWEKLRGLMEERLRALQGQHEESHLLEQCQGLDAAVAQLTKFVQQNQASLNRVLLAEEKAWDAKGRLEESRAGELAAYVQENLEAAQLAGELARQEMHGELVLLREKSRALEASVAQLAGQLKELSGHLPALSSRLDLQEQMLGLRLSEAKTEWEGAERKSLEDLARWRKEVTEHLRGVREKVDGLPQQIESVSDKCLLHKSDSDLRISAEGKAREFKVGALRQELATLLSSVQLLKEDNPGRKIAEMQGKLATFQNQIMKLENCVQANKTIQNLRFNTEARLRTQEMATLWESVLRLWSEEGPRTPLGSWKALPSLVRPRVFIKDMAPGKVVPMNCWGVYQAVRWLRWKASLIKLRALRRPGGVLEKPHSQEQVQQLTPSLFIQK

SEQ ID NO: 11244 - protein, 752 aa, Homo sapiens
MAHLLGSQACMESLRTDLTDLQGAIVDVFSRAGPVRFPSWKFPDRMACDLDMVALLEHYDHVPGDPEFTQLSHAVLLELVIDRLLLLLQSCMSYLENLGSEQMMPPAQAAGPCMSVGLTVRRFWDSLLRLGTLHQQPLPQKGANQRETPTSKPTTKGEPARSPEYLTTKLIKPSSPVLGLPQTCQEPESIPVRASLQFPATTFKNTRSVHSQTIETALVPCDACASVQGSLQKVGKVVISLCQSQNLPSSLGQFQQLVQDSMGLRPLPAATVGRWAAEQRKDLTRLSKHVEALRAQLEEAEGQKDGLRKQAGKLEQALKQEQGARRRQAEEDEQCLSEWEHDKQQLLTETSDLKTKMATLERELKQQRESTQAVEAKAQQLQEEGERRAAAERQVQQLEEQVQQLEAQVQLLVGRLEGAGQQVCWASTELDKEKARVDSMVRHQESLQAKQRALLKQLDSLDQEREELRGSLDEAEAQRARVEEQLQSEREQGQCQLRAQQELLQSLQREKQGLEQATTDLRLTILELERELEELKERERLLVAFPDLHRPTETQIHGGRSSSVESQITCPTDSGNVTDHMERQVQSNDIRIRVLQEENGRLQSMLSKIREVAQQGGLKLIPQDRLWSPSSKGTQGATPPVQAKSTSPGPLGRQHLPSSRTGRTLLGQPCTSPPRQPCTSPPRQPCTSPPRQPCTSPSRQPCSQPSKSLLEGVTHLDTCTQNPIKVLVRLRKRLSPGRGQASSAHQPQERPM

SEQ ID NO: 11245 - protein, 752 aa, Homo sapiens; identical to SEQ ID NO: 11244

SEQ ID NO: 11246 - protein, 533 aa, Homo sapiens
MESKAWESNNEDLLSSSGVTSNGGSSSSFFVSSIRGTIIENTSSAGTLTQVPFFPKYEVELDSPRKIIPSPGKEHFERVLEEYSHQVKDLQRRLNESNELHEKQKFYLRQSVIDLQTKLQEMQMERDAMADIRRRESQSQEDLRNQLQNTVHELEAAKCLKEDMLKDSNTQIEQLRKMMLSHEGVLQEIRSILVDFEEASGKKICEHDSMSTLHFRSLGSAISKILRELDTEISYLKGRIFPVEDQLEALKSESQNKIELLLQQHQDRIEQLISEHEVEITGLTEKASSARSQANSIQSQMEIIQEQARNQNSMYMRQLSDLESTVSQLRSELREAKRMYEDKTEELEKQLVLANSELTEARTERDQSSLRSDMCHRSNNSLRDSTEGSKSSETLSREPVTLHAGDREDPSGCFTFTSAASPSVKNSASRSFNSSPKKSPVHSLLTSSVEGSIGSTSQYRSAKPIHSSDSVKDSQSPPIETTGKTCRKLQNRLESLQTLVEDLQLKNQAMSSMIRNQEKRIQKVKDQEKMLLK

SEQ ID NO: 11247 - protein, 1113 aa, Homo sapiens
MESKAWESNNEDLLSSSGVTSNGGSSSSFFVSSIRGTIIENTSSAGTLTQVPFFPKYEVELDSPRKIIPSPGKEHFERVLEEYSHQVKDLQRRLNESNELHEKQKFYLRQSVIDLQTKLQEMQMERDAMADIRRRESQSQEDLRNQLQNTVHELEAAKCLKEDMLKDSNTQIEQLRKMMLSHEGVLQEIRSILVDFEEASGKKICEHDSMSTLHFRSLGSAISKILRELDTEISYLKGRIFPVEDQLEALKSESQNKIELLLQQHQDRIEQLISEHEVEITGLTEKASSARSQANSIQSQMEIIQEQARNQNSMYMRQLSDLESTVSQLRSELREAKRMYEDKTEELEKQLVLANSELTEARTERDQFSQESGNLDDQLQKLLADLHKREKELSLEKEQNKRLWDRDTGNSITIDHLRRELDNRNMEVQRLEALLKALKSECQGQMERQMAAIQGKNESLEKVSSLTAQLESTKEMLRKVVEELTAKKMTLESSERTISDLTTSLQEKERAIEATNAEITKLRSRVDLKLQELQHLKNEGDHLRNVQTECEALKLQMTEKDKVIEILRQQIENMTQLVGQHGRTAGAMQVEKAQLEKEINDRRMELKELKILKDKKDAKIRELEARVSDLELEKVKLVNAGSERLRAVKDIKQERDQLLNEVKTSRSELNNLSEEYEVLKRNFRNKSEEMEMTTNKLKMQLKSAQSELEQTRNTLKSMEGSDGHAMKVAMGMQKQITAKRGQIDALQSKIQFLEEAMTNANKEKHFLKEEKSKLSQELSTVATEKNKMAGELEVLRSQERRLKEKVTNMEVALDKASLQFAECQDIIQRQEQESVRLKLQHTLDIKELQGPGYTSNSSLKPRLLQPASVTRSHSNVPSSQSTASFLSHHSTKANTLKEDPTRDLKQLLQELRSVINEEPAVSLSKTEEDGRTSLGALEDRVRDCITESSLRSDMCHRSNNSLRDSTEGSKSSETLSREPVTLHAGDREDPSGCFTFTSAASPSVKNSASRSFNSSPKKSPVHSLLTSSVEGSIGSTSQYRSAKPIHSSDSVKDSQSPPIETTGKTCRKLQNRLESLQTLVEDLQLKNQAMSSMIRNQEKRIQKVKDQEKMLLK

SEQ ID NO: 11248 - protein, 412 aa, Homo sapiens
MLLPASDPLLAGLPRDPDYSVSCLYSPPSPSSMCLPANMKCDKYWGSSSDKALERTAHWSRTPEPETLGCPASGDTVRTADCRPGWGSGPSPHEAAPSPSPDLQKQCCNDQDILKRHHNVAKKPLETSSSKVKAKTIVMIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELVREEVTFIYQKLQAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDCDQDLSQPPFSKSGRSFPPG

SEQ ID NO: 11249 - protein, 297 aa, Homo sapiens
MGEHEQVKPLETSSSKVKAKTIVMIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELVREEVTFIYQKLQAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDCDQDLSQPPFSKSGRSFPPA

SEQ ID NO: 11250 - protein, 297 aa, Homo sapiens; identical to SEQ ID NO: 11249

SEQ ID NO: 11251 - protein, 325 aa, Homo sapiens
MDARRKHWKENMFTPFFSAQDVLEETSEPESSSEQTTADSSKGMEEIYNLSSRKFQEESKFKRKKYIFQLNEIEQEQNLRENKRNISKNETDTNSASYESSNVDVTTEESFNSTEDNSTCSTDNLPALLRQDIRKKFMERMSPKLCLNLLNEELEELNMKYRKIEEEFENAEKELLHYKKEIFTKPLNFQETETDASKSDYELQALRNDLSEKATNVKNLSEQLQQAKEVIHKLNLENRNLKEAVRKLKHQTEVGNVLLKEEMKSYYELEMAKIRGELSVIKNELRTEKTLQARNNRALELLRKYYASSMVTSSSILDHFTGDFF

SEQ ID NO: 11252 - protein, 325 aa, Homo sapiens; identical to SEQ ID NO: 11251

SEQ ID NO: 11253 - protein, 740 aa, Homo sapiens
MNPPGSLEALDPNVDEHLSTQILAPSVHSDNSQERIQARRLRIAARLEARRREALGEYLDGKKESEEDQSKSYKQKEESRLKLAKLLLCGTELVTNIQVAIDIREIHRRVEEEEIKRQRIEKLENEVKTSQDKFDEITSKWEEGKQKRIPQELWEMLNTQQLHCAGLLEDKNKLISELQQELKTKDDQYVKDLKKQSDDICLLLERMEEQVKNVMKTFREELYNIEKAFEVERQELLASNKKKWEQALQAHNAKELEYLNNRMKKVEDYEKQLNRQRIWDCEEYNMIKIKLEQDVQILEQQLQQRKAIYQLNQEKLEYNLQVLKKRDEESTVIKSQQKRKINRLHDILNNLRSKYAKQIKQFQEENQSLTSDYKRLVMQFKELQKAMRHFALIDDEKFWEIWLMNEEEAKDLIARAFDVDRIIHTHHLGLPWAAPDFWFLNNVGPISQQPQKSATQIVEEMLMRSEEEEAEEAAAEPESYLDLPKQISEKTTKRILMLLCDESGFLIESKLLSLLLPLEQNECYLLRLDAIFSALGIESEDDLYKLVNFFLKYRAHRLSSSLQIKPCSQASMEKASMEETSTRSELELAEQTEMEGEKEESLVEGEKEEEEETPPSPWVIHPNDVLKILEAFVMGLKKPRDSRAPLRVQKNVRDNSKDSEYWQALTTVIPSSKQNLWDALYTALEKYHLVLTQRAKLLLENSSLEQQNTELQALLQQYLNSKINSELQVPPTQVLRVPTK

SEQ ID NO: 11254 - protein, 173 aa, Homo sapiens
MGSHSPSHFLVHGWILSMMFPEEEEAEEAAAEPESYLDLPKQISEKTTKRILMLLCDESGFLIESKLLSLLLPLEQNECYLLRLDAIFSALGIESEDDLYKLVNFFLKYRAHRLSSSLQIKPCSQASMEKASMEETSTRSELELAEQTEMEGEKEESLVEGEKEEEEETPPSP

SEQ ID NO: 11255 - protein, 976 aa, Homo sapiens
MHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQNCCGYPRINIEEETLGFTRLPAGSTVKTLKSLGLQRLELEEKTENKLGELGSSAESKGALKKEREVHQKLLADSHSLVMDLRWQIHHSEKNWNREKVELLDRLDRDRQEWERQKKEFLWRIEQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMEELPCSALAPSLEPCFSRPERPANRRPPSRWAPHSPTASQPQSPGDPTSLEEHGGEEPPEEQPHRDASLHGLSQYNSL

SEQ ID NO: 11256 - protein, 1586 aa, Homo sapiens
MEEMRDSYLEEDVYQLQELRRELDRANKNCRILQYRLRKAEQKSLKVAETGQVDGELIRSLEQDLKVAKDVSVRLHHELKTVEEKRAKAEDENETLRQQMIEVEISKQALQNELERLKESSLKRRSTREMYKEKKTFNQDDSADLRCQLQFAKEEAFLMRKKMAKLGREKDELEQELQKYKSLYGDVDSPLPTGEAGGPPSTREAELKLRLKLVEEEANILGRKIVELEVENRGLKAEMEDMRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLELRGPPVLPEQSVSIEELQGQLVQAARLHQEETETFTNKIHKMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMENQTVLLTAPWGL

SEQ ID NO: 11257 - protein, 1545 aa, Homo sapiens
MEEMRDSYLEEDVYQLQELRRELDRANKNCRILQYRLRKAEQKSLKVAETGQVDGELIRSLEQDLKVAKDVSVRLHHELKTVEEKRAKAEDENETLRQQMIEVEISKQALQNELERLKESSLKRRSTREMYKEKKTFNQDDSADLRCQLQFAKEEAFLMRKKMAKLGREKDELEQELQKYKSLYGDVDSPLPTGEAGGPPSTREAELKLRLKLVEEEANILGRKIVELEVENRGLKAEMEDMRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMENQTVLLTAPWGL

SEQ ID NO: 11258 - protein, 439 aa, Homo sapiens
MAPKKKRGPSAGSQPGGAAAAGAEQPLSERAQYLQREHALLSEQLDTCEESVDQVLRENAFLDREALRLREENRLYASYVSARAQRCAKAIVRLDEQNRVDLAQIHWQRAELASLYHGREDGVRAQLLEMEARAAQMAQQVQELQPYKVLQLEQLARIRALERELLHMRVEHTQLLHRVKRRFLEDKAAFEREARQRVQSLARRAEREAVRALVAHTQAIKADNGRLRQELLLLLRRTQLLHHTRRQLLEQREQLHREHEDTRDLARVHGWLRRGPGGPPLWERPAFSQPTSRPGSLAAPISPSRAASQTPSVVPSRAAPRASSVVPSREASRVPSLVLSSMDSRVPSLATSKVGSRMPSLTASRAGSRALSLVQSLEGSGISSGSSPRVSSQDTLRSTKSGPKLLSGLSRDRDPALLPPQSEDSVNAEAAAEASPGRA

SEQ ID NO: 11259 - protein, 2452 aa, Homo sapiens
MAQIQKDKANISEKSVMHPEYIAVKAEKSPLSHILKTKELQVNISQQGEKAQEGEVEIVVLLSKTCPFVTSSAFLELDSIKEEEGEPRITRSFMPHLEIQESLPSRQTAPTKPTESLVKKEKQLLPQKEDRVQTVSMHGLMHPNGAVFKAKTSAPPQVFSITEHSPLSKRKEPQWGMKERAGQKQDRTGRPHVILTKTHPFMPSLSHHRFSPSQPKLPISSGAGKSRLANSNEGISSHKVILKANQQMPYKEAKDRVKIEGREGRILPKRIHLRAEALPLALLCNGKNYSLHIEEQGEGVQESKKEPGVVPRKSASFPPPPFYLNCDTRRNEKEGTLGKTQFSFPPLKIQDSSDSGKKAYTESLHGYTLSNSKGPVQPTAQGEEKGGLRIDMEDKMLPKCTDLKAKQLLLSDILNTKKLQWKSKEQKRKIQEDKNKQVKGLPSINTSLLTPPYLKFDTTEGQENVIRIAKVSLPQSRSKESSDAGRIACPEATHGELSSDVKQLKAHLLQKEEKDREKVADMTSVLDPNKMYLKAKKSPVLHTHSFSDLQWKTREQEEEKVQKVKSGPGVMLSKSPSRSSPLHLNVNTGFQEESIPILTRPSFPLVKLQVSPDTEGGTCIRPIAGDILIYLQKGKHVSQNKEEDDVQIVSILIFPKHQEEKVQECEGEPGVVLTKSTSLPSLSQLELDKETHLGNEMLRLKRPILRRISHIGETVHRESVVGDIPKDVKNEKQHIPQKEERNQKKIIDMRGTDITLKSKKSPRSCMLHRTELHVNIGGQGRKEHEGQDKPPGMIQRKMCILFSKPLPSNLKLERATHADEERLGGKTSFVLPLMPSALPDTEKTADAEARSGDVRKGKPHRSQKENRHEVKTIDMRFRIHCQEARISPMSHILNAKELVLNINKLEKKVHKDKDEACVVLSRTFLSIPSAPPLYLDSGNKTDKDTPGITGSSCPQRTLHVPSNTQKITNRDSVEGVDKNVVKQAEQYVPRPEAEQQLTSNFMISVQQRNQPSRVRSEEDLNQLVLNSRDEDIYFTGFGTIRSGKRPEWLFTGKKAQPVKYKTETLTAFLSYPTMDATKMGGLEEDTEIMDNLNHKISPKASVSLIRKISKELYVTLGTPANSKGFSVSERYAHQQETSSKVSPELAGSCKFDKPKEDGQSNDRISKMFSPKVLAPQTKGSLKKISIVTNWNAPQNIEEQDIVMKKQVIRRCEHGHKTRTNTILSKFPLQSGKQKTPSETDVDKKTTAHLSLQMLPGIHMDMTEIDPAKGGRKQALLISEQEEGVLEFLPKSLFPPWTFQFQSGDLEEKHQTDANTNINLEQKKLEMDNDSTVNQKEGKLKIGTNRALHLQEEKTEMHKARTANLEKERGRMDTSSSAHPHLLSLKAEESQMKTQVITHRENSRLIMQKQKKELEASNAKQSIQLQKLFQRNVLDSFYSYVPLSPKRKDQKGRLTIRDLKRELSTKYLTMKIQNHPIPQMLNITGRGTPSNRKKLEYDVKLKNIASWSKDVSGIFIRSLSISIMRSPHTDPKTNLEREKRICLPKFQEKSPNTSEMSKRDTLTIVKGEQNFTNTVPQDPQPFAVDKQQMQKLPNVKSEANLRSEMNKKYLKAQTKERIVPEHDVSRIIKKPDLRIIEQEEKILKRILTPTECPSMLEDPKLPKQRDQSEPVWDMTTQKVQQQKAFPGTVPIPPQVKSSEVKIVADSTNAEHLLPICEATKAISESQVKNMIQDKVSSDKLDNIQAYKPDDLKSPPFPEGPDTISTAIYPKTQHKSLLEQFTPKEKNKLTSHLESKALEIQLNLIPEMARKSLQMFNFYPKGTISKDNSWRFYSRHKTMNFMSLEGTDTIEPNSKHKHQKDSPLASNMKTLIVDVSSDSEETITKLQSINKLENGTSAVTSASEMLLPHTLQNHSVKEKGKLLMHFSVKTLEIQMKAFPRIVRESYAMTSAHERKKPLSNCIHPGFTGPKRQNRILLLSEEKSLHQIDLDLQYKYLRFLLGLPVGSTFPKPNVLPKHSKLNTIAVCKNVNAGGQSGSLSIDTELLEQHISFKKQSPHENSSLIRKFPQPTLVCASDRDLHSPRKKDTQVLSESEFHVTPEKNKQYHVWFQERNTCESVDLRTQRNATGSAVSCETQISEDFVDIQTDIESPADLDECSCLEVSESEECVFLEANSYLSQESENILFELQTGIPLENVYKITTDLKSFYSEDSGSHCTRECRKETLIITPPSCKSHKSRKYRSSSKMKSPDWLCHSSSNTAEIQSRSSSVSFSEEKISWTTKSRTSYSSAPLTESNIKSHLAKNQGKSHRHPESQERKKARSDLFRKNSSHWDHDYSCTHSKGKRDRKKRVYDYESERLDCFQSKHKSASKPHHDDINFYSERKQNRPFFFACVPADSLEVIPKTIRWTIPPETLRKRNFRIPLVAKISSSWNIWSSSKKLLGSLSGSLTTVFHS

SEQ ID NO: 11260 - protein, 214 aa, Homo sapiens
MKEERNYNFDGVSTNRLKQQLLEEVRKKDAVQLSIFELRHKITELEAKLNTDNEGSEWKTRYETQLELNDELEKQIVYLKEKVEKIHGNSSDRLSSIRVYERMPVESLNTLLKQLEEEKKTLESQVKYYALKLEQESKAYQKINNERRTYLAEMSQGSGLHQVSKRQQVDQLPRMQENLVKTGRYNPAKQKTVSAKRGPVKKITRPNHLPELHP

SEQ ID NO: 11261 - protein, 141 aa, Homo sapiens
METLQESLNTLLKQLEEEKKTLESQVKYYALKLEQESKAYQKINNERRTYLAEMSQGSGLHQVSKRQQVDQLPRMQENLVKTLLLKEELDPLKVSCLETLGFSAAGVAGPENRTCLGQKALWPACLHGSSTLAVCQTHLKS

SEQ ID NO: 11262 - protein, 112 aa, Homo sapiens
MPVESLNTLLKQLEEEKKTLESQVKYYALKLEQESKAYQKINNERRTYLAEMSQGSGLHQVSKRQQVDQLPRMQENLVKTGRYNPAKQKTVSAKRGPVKKITRPNHLPELHP

SEQ ID NO: 11263 - protein, 139 aa, Homo sapiens
MPVESLNTLLKQLEEEKKTLESQVKYYALKLEQESKAYQKINNERRTYLAEMSQGSGLHQVSKRQQVDQLPRMQENLVKTLLLKEELDPLKVSCLETLGFSAAGVAGPENRTCLGQKALWPACLHGSSTLAVCQTHLKS

SEQ ID NO: 11264 - protein, 139 aa, Homo sapiens; identical to SEQ ID NO: 11263

SEQ ID NO: 11265 - protein, 112 aa, Homo sapiens; identical to SEQ ID NO: 11262

SEQ ID NO: 11266 - protein, 241 aa, Homo sapiens
MKEERNYNFDGVSTNRLKQQLLEEVRKKDAVQLSIFELRHKITELEAKLNTDNEGSEWKTRYETQLELNDELEKQIVYLKEKVEKIHGNSSDRLSSIRVYERMPVESLNTLLKQLEEEKKTLESQVKYYALKLEQESKAYQKINNERRTYLAEMSQGSGLHQVSKRQQVDQLPRMQENLVKTLLLKEELDPLKVSCLETLGFSAAGVAGPENRTCLGQKALWPACLHGSSTLAVCQTHLKS

SEQ ID NO: 11267 - protein, 590 aa, Homo sapiens
MDSHSGEPALLPCGTCDMVFRSSALLATHTQRFCIGHPTQEMTFGAQASVATEPQRAAVQWLRLSLQEMRPWITEVPRVFAGPWTRSEARPQSPMSEAVGSPSERLRALFRTRARRVAEMEAQSRALQLRGEELSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAENRRLEAEILALQMQRGRAPLGPQDLRLLGDASLQPKGRRDPPLLPPPVAPPLPPLPGFSEPQLPGTMTRNLGLDSHFLLPTSDMLGPAPYDPGAGLVIFYDFLRGLEASWIWVQLRTGLARDGRDTGRTTALPPALCLPPPPAPGPMGNCAILASRQPVPRLPPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVSSTSSLEASFLTPAVGFADPPPRTEEPLSGVKDRDEGLGPHHSSDLPPVSF

SEQ ID NO: 11268 - protein, 110 aa, Homo sapiens
MDSHSGEPALLPCGTCDMVFRSSALLATHTQRFCIGHPTQEMTFGAQASVATEPQRAAVSSTSSLEASFLTPAVGFADPPPRTEEPLSGVKDRDEGLGPHHSSDLPPVSF

SEQ ID NO: 11269 - protein, 613 aa, Homo sapiens
MDSHSGEPALLPCGTCDMVFRSSALLATHTQRFCIGHPTQEMTFGAQASVATEPQRAAVVPQEHQGVPQEPQGLPDQQASRSALKRLTEEEMRPWITEVPRVFAGPWTRSEARPQSPMSEAVGSPSERLRALFRTRARRVAEMEAQSRALQLRGEELSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAENRRLEAEILALQMQRGRAPLGPQDLRLLGDASLQPKGRRDPPLLPPPVAPPLPPLPGFSEPQLPGTMTRNLGLDSHFLLPTSDMLGPAPYDPGAGLVIFYDFLRGLEASWIWVQLRTGLARDGRDTGRTTALPPALCLPPPPAPGPMGNCAILASRQPVPRLPPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVSSTSSLEASFLTPAVGFADPPPRTEEPLSGVKDRDEGLGPHHSSDLPPVSF

SEQ ID NO: 11270 - protein, 622 aa, Homo sapiens
MDSHSGEPALLPCGTCDMVFRSSALLATHTQRFCIGHPTQEMTFGAQASVATEPQRAAVVPQEHQGVPQEPQGLPDQQASRSALKRLTEEVQWLRLSLQEMRPWITEVPRVFAGPWTRSEARPQSPMSEAVGSPSERLRALFRTRARRVAEMEAQSRALQLRGEELSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAENRRLEAEILALQMQRGRAPLGPQDLRLLGDASLQPKGRRDPPLLPPPVAPPLPPLPGFSEPQLPGTMTRNLGLDSHFLLPTSDMLGPAPYDPGAGLVIFYDFLRGLEASWIWVQLRTGLARDGRDTGRTTALPPALCLPPPPAPGPMGNCAILASRQPVPRLPPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVSSTSSLEASFLTPAVGFADPPPRTEEPLSGVKDRDEGLGPHHSSDLPPVSF

SEQ ID NO: 11271 - protein, 283 aa, Homo sapiens
MKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEAKNGKYLRTTKCSWRIKKYFKTTPGIERCTTEGSIIIRGKIHYYKGSHS

SEQ ID NO: 11272 - protein, 803 aa, Homo sapiens
MVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVAESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIK

SEQ ID NO: 11273 - protein, 1299 aa, Homo sapiens
MESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVAESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMEKNEKIRSLETNINTEHEKICLAFEKAKKIHLEQHKEMEKQIERLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIKLEGTLEKSELELKECNKQIESLNDKLQNAKEQLREKEFIMLQNEQEISQLKKEIERTQQRMKEMESVMKEQEQYIATQYKEAIDLGQELRLTREQVQNSHTELAEARHQQVQAQREIERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKGENV

SEQ ID NO: 11274 - protein, 1417 aa, Homo sapiens
MASPTNGHHGGNCGKCSPGRAPLVGSGALADHDPRQAPRLRRRLTQSAPGRGSDRVGASQRLPRRFEFCAAGVRWFSELCPRLPRAGARERVRGFLTQTRVRSAQSPGGSLPSDDLGEMESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVAESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMEKNEKIRSLETNINTEHEKICLAFEKAKKIHLEQHKEMEKQIERLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIKLEGTLEKSELELKECNKQIESLNDKLQNAKEQLREKEFIMLQNEQEISQLKKEIERTQQRMKEMESVMKEQEQYIATQYKEAIDLGQELRLTREQVQNSHTELAEARHQQVQAQREIERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKGENV

SEQ ID NO: 11275 - protein, 66 aa, Homo sapiens
MDPPARKEKTKVKESVSRVEKAKQKSAQQELKQRQRAEIYALNRVMTELEQQQFDEFCKQMQPPGE

SEQ ID NO: 11276 - protein, 66 aa, Homo sapiens; identical to SEQ ID NO: 11275

SEQ ID NO: 11277 - protein, 66 aa, Homo sapiens; identical to SEQ ID NO: 11275

SEQ ID NO: 11278 - protein, 307 aa, Homo sapiens
MLRHSPSLWELVEEHVPLRERREVKRILGEAAVDLSLELRAEVAMLRALLQEARSSQAPSSRPISDPSSLLAPPPLLKDLLRQELRQLLQGLRHKAICEGRDQAQAWVQYSPRVLHFALEEPRCDLPEQEIFQMRGGGPSSGHRDLSIIKDQLNVSNIDQVARHLRGLLEEECHTLEREILILQRCLEEEYLRPCHPSEAALEPTLAELKEQKKAMEQELQASVGPSCVSPNHRQRPLGSSTQGLRPPLPLCGVAPLQCCLPAPPLEPYLRPRGQSATHRWGRQLQCSPREGPASTPMSSAAPQAPA

SEQ ID NO: 11279 - protein, 208 aa, Homo sapiens
MVFYFTSSSVNSSAYTIYMGKDKYENEDLIKHGWPEDIWFHVDKLSSAHVYLRLHKGENIEDIPKEVLMDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRSYSSLMKVENMSSNQDGNDSDEFM

SEQ ID NO: 11280 - protein, 140 aa, Homo sapiens
MDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRSYSSLMKVENMSSNQDGNDSDEFM

SEQ ID NO: 11281 - protein, 656 aa, Homo sapiens
MFEAIFPSTPQARLKRDPREKPGLSSFRSTFRQQSSLGLCIPRLMLPKEASPSQRHSSMSSSMARALVLLQSMASRDARCPEWKPHQKPRTLSKSVQTISRYYRKTSEPKDAASLTGFMSKMELRRVFPTHPDCPQFSTRATSMSHCGSPTEADLSGEIDNSSETWRGTQDLFLARRGSDTNVDGYLLPFSKSICEFDYLRKRRKSQTLSPVTSSSVASQSCLRKRMPWYLSVIHEKDHCLSELEIQVQKKDEEILLLQEEREALKMQLKCLLKGKGQETSMSPGRREQLSDASLKLGRLSLLKAFSRHEEELQHWWQMQEESAAPERGKEPDLGGGEEDEGLEGEPDGVEDTGAWGGVSQMGSVHEEGSEEEEEEEGDRDEDSEERELPEEEEIPRRRASSLAESFEEELLAQLEEYEQVILDFQFNLEATRTRYSLATGVIASLQQQVDFQETQLRKINTENETLQKELRERRQQLQAMTDKFSNLREDKKHQEMMGLIEKDNQLLRQQVSELERKLTKRDCVISELDTKVSQLQEQVELDQNHLQRWKQLQEDLQSKKEMIQQAEQHTRVALESSQSRLERLRNKIIQATFSISGTKSLANEISDNDILEALQRIISERSDYYNQLKQKGVKVPPLQQSEAFLTSKSKKGTSK

SEQ ID NO: 11282 - protein, 161 aa, Homo sapiens
MPKNAIPVSKSTGFSNPASQSTSQRPKLKRVMKEKTKPQGGEGKGAQSTPIQHSFLTDVSDVQEMERGLLSLLNDFHSGKLQAFGNECSIEQMEHVRGMQEKLARLNLELYGELEELPEDKRKTASDSNLDRLLSDLEELNSSIQKLHLADAQDVPNTSAS

SEQ ID NO: 11283 - protein, 274 aa, Homo sapiens
MPRAEPRATLGEQEKAGLPLGAWRLYLLRHFRKQTELRRSGSRDVTGALLVAAAVASEAVGSLRVAEGGPNTLLLQVLRSWPWCNKELKTMEERKVKRRSPKSFSAHCTQVVNAKKNAIPVSKSTGFSNPASQSTSQRPKLKRVMKEKTKPQGGEGKGAQSTPIQHSFLTDVSDVQEMERGLLSLLNDFHSGKLQAFGNECSIEQMEHVRGMQEKLARLNLELYGELEELPEDKRKTASDSNLDRLLSDLEELNSSIQKLHLADAQDVPNTSAS

SEQ ID NO: 11284 - protein, 783 aa, Homo sapiens
MSQEKNEMFESEWSKEREREKQLASGLDTAEKALKVESEELQKSKSELICLYNEVHNLPGESESKDHFLIACDLLQRENSELETKVLKLSQEFAQLNHFTLGGKTAPSNLITSENTCKDPESNEPILETEIQSRKEETEELCPKLGERKQKEIPEESVKEGSFPREGQKEEGSQQNRDMKDEEKEQQLTMKPEEIVRLREELSHINQSLLQSQSSGDSSDDSGAQHPSSGEKLKYNQQGEVQQLHQNLHRLQILCNSAENELRYERGQNLDLKQHNSLLQEENIKIKIELKHAQQKLLDSTKMCSSLTAEYKHCQQKIKELELEVLKHTQSIKSQNNLQEKLVQEKSKVADAEEKILDLQRKLEHAHKVCLTDTCISEKQQLEEKIKEATQNEAKVKQQYQEEQQKRKLLYQNVDELHRQVRTLQDKENLLEMTCSQQQSRIQQQEALLKQLENEKRKYDEHVKSNQELSEKLSKLQQEKEALREEYLRLLKLLNVHVRNYNEKHHQQKVKLQKVKYRLTNEVELRDKRINQFEDEIGILQHKIEKEKAIQDQITAQNDTLLLEKRKLQEQVIEQEQLIHSNKWTISSIQSRVLYMDKENKQLQENSLRLTQQIGFLERIIRSIHIRRGENLKEFPVPKWWHRGKLASLPPTKKQKEIYSTEVFTSNNAELQHEDESVPEATEKWKHSEQMETTISDILESEVVNEILPLSNSSFSGKGLVESFASLQETEEIKSKEAMASSKSPEKSPENLVCSQNSEAGYINVASLKETHGIQEQDQKSEL

SEQ ID NO: 11285 - protein, 783 aa, Homo sapiens; identical to SEQ ID NO: 11284

SEQ ID NO: 11286 - protein, 572 aa, Homo sapiens
MIHPPRPPKVLGLQHPSSGEKLKYNQQGEVQQLHQNLHRLQILCNSAENELRYERGQNLDLKQHNSLLQEENIKIKIELKHAQQKLLDSTKMCSSLTAEYKHCQQKIKELELEVLKHTQSIKSQNNLQEKLVQEKSKVADAEEKILDLQRKLEHAHKVCLTDTCISEKQQLEEKIKEATQNEAKVKQQYQEEQQKRKLLYQNVDELHRQVRTLQDKENLLEMTCSQQQSRIQQQEALLKQLENEKRKYDEHVKSNQELSEKLSKLQQEKEALREEYLRLLKLLNVHVRNYNEKHHQQKVKLQKVKYRLTNEVELRDKRINQFEDEIGILQHKIEKEKAIQDQITAQNDTLLLEKRKLQEQVIEQEQLIHSNKWTISSIQSRVLYMDKENKQLQENSLRLTQQIGFLERIIRSIHIRRGENLKEFPVPKWWHRGKLASLPPTKKQKEIYSTEVFTSNNAELQHEDESVPEATEKWKHSEQMETTISDILESEVVNEILPLSNSSFSGKGLVESFASLQETEEIKSKEAMASSKSPEKSPENLVCSQNSEAGYINVASLKETHGIQEQDQKSEL

SEQ ID NO: 11287 - protein, 783 aa, Homo sapiens; identical to SEQ ID NO: 11284

SEQ ID NO: 11288 - protein, 39 aa, Homo sapiens
MSQEKNEMFESEWSKEREREKQLASGLDTAEKALKVESE

SEQ ID NO: 11289 - protein, 367 aa, Homo sapiens
MGEPGPPSPPAPKAAPGLIDSFSEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPVDPGELGAGGDLTERLQETHGPGHSECTETLPAQDLLSGTSDKFNLLAKLEHAQSRILSLESQLEDSARRWGREKQDLATRLQEQEKGFRHPSNSIIIEQPVSDPPGVAPRGSGGGAGSHRTPKVTGP

SEQ ID NO: 11290 - protein, 1023 aa, Homo sapiens
MAFRGPEPWVSASLLRQRLKAEEKTLDLEFEVLSVGFNEAGRYALRLSAENPLQVGSGAGVQLQVNDGDPFPACSAITDVIEQQEPGQSLTLTRSKFIFTLPKGFCKNDGQHDAQLHVEALRLDEPLGRAAQRVGEAIFPIYPRPDQPRMNPKAQDHEDLYRYCGNLALLRASTDPTARHCGSLAYSVAFHVHRGPQPPVSDSPPRAGQPELISPEEPLIASQSTEPEIGHLSPSKKETIMVTLHGATNLPACKDGSEPWPYVVVKSTSEEKNNQSSKAVTSVTSEPTRAPIWGDTVNVEIQAEDAGQEDVILKVVDNRKKQELLSYKIPIKYLRVFHPYHFELVKPTESGKADEATAKTQLYATVVRKSSFIPRYIGCNHMALEIFLRGVNEPLANNPNPIVVIARVVPNYKEFKVSQANRDLASVGLPITPLSFPIPSMMNFDVPRVSQNGCPQLSKPGGPPEQPLWNQSFLFQGRDGATSFSEDTALVLEYYSSTSMKGSQPWTLNQPLGISVLPLKSRLYQKMLTGKGLDGLHVERLPIMDTSLKTINDEAPTVALSFQLLSSERPENFLTPNNSKALPTLDPKILDKKLRTIQESWSKDTVSSTMDLSTSTPREAEEEPLVPEMSHDTEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPVDPGELGAGGDLTERLQETHGPGHSECTETLPAQDLLSGTSDKFNLLAKLEHAQSRILSLESQLEDSARRWGREKQDLATRLQEQEKGFRHPSNSIIIEQPPYSLPPAPGASIFGKPRATVDPGGWREEAFQSRGQGDGPLPDPEKKQGHQRPALLGNTREACPFHLPQNIYHV

SEQ ID NO: 11291 - protein, 755 aa, Homo sapiens
MGLKNKKNTEDPEEPLIASQSTEPEIGHLSPSKKETIMVTLHGATNLPACKDGSEPWPYVVVKSTSEEKNNQSSKAVTSVTSEPTRAPIWGDTVNVEIQAEDAGQEDVILKVVDNRKKQELLSYKIPIKYLRVFHPYHFELVKPTESGKADEATAKTQLYATVVRKSSFIPRYIGCNHMALEIFLRGVNEPLANNPNPIVVIARVVPNYKEFKVSQANRDLASVGLPITPLSFPIPSMMNFDVPRVSQNGCPQLSKPGGPPEQPLWNQSFLFQGRDGATSFSEDTALVLEYYSSTSMKGSQPWTLNQPLGISVLPLKSRLYQKMLTGKGLDGLHVERLPIMDTSLKTINDEAPTVALSFQLLSSERPENFLTPNNSKALPTLDPKILDKKLRTIQESWSKDTVSSTMDLSTSTPREAEEEPLVPEMSHDTEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPDLLSGTSDKFNLLAKLEHAQSRILSLESQLEDSARRWGREKQDLATRLQEQEKGFRHPSNSIIIEQPSALTHSMDLKQPSELEPLLPSSDSKLNKPLSPQKETANSQQT

SEQ ID NO: 11292 - protein, 333 aa, Homo sapiens
MGEPGPPSPPAPKAAPGLIDSFSEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPDLLSGTSDKFNLLAKLEHAQSRILSLESQLEDSARRWGREKQDLATRLQEQEKGFRHPSNSIIIEQPVSDPPGVAPRGSGGGAGSHRTPKVTGP

SEQ ID NO: 11293 - protein, 594 aa, Homo sapiens
MNFNVWNIKEMLSIPSGSGNKKSSNWNNNQNDYSSLSDSQFLFGSQFCPENSETLSAPLDFGAHLRHSKQSQQNYLEGEPSIFTKYQTKPQLFGGDIKDGGLFPPPLSVGKSKGLLEQFEEKKKRAKDKCDSETLYNFVSNVRESILRLQTSVEKSEDHLSSRSQSILDSLETVAKTLQETIQAQNDLVFEAVQDKGNMEQAILEMKKRFEARQGEFIEMKSNLKHLEVLVAQQSQEFQQLCEQLGQLNVPSVLAELKRLISVPPVKDSASQTSPPLAQSLNLTRQEKYTSEKPVLWQAQALPAAWNPGMGSLQPGEFDVWGEGAKNDDLQEEAALPAFGSHERNRHVKDKVVQTNCKNWAVTKTGAKNHGSSVPGHKIPSDRDLVSQGASQLTSLEINFSTSIKNACQKYQAQSMFLCDPREHLVIKQKDGTVEMRGKDKKQQPRKAHRAHRGRLIASKQKQIPIQTCKFNSKYQSPQPAISVPQSPFLGQQEPRAQPLHLQCPRSPRKPVCPILGGTVMPNKTVRAVQGRLLQLSRCSSQDNWLLSSSSQGDHQMSWFSDLNLGCSETPLCKEAGKNLLYDLGFDSSDDDGF

SEQ ID NO: 11294 - protein, 574 aa, Homo sapiens
MARVDAKAKEAPRASEGCQHAVTSQRNKKSSNWNNNQNDYSSLSDSQFLFGSQFCPENSETLSAPLDFGAHLRHSKQSQQNYLEGEPSIFTKYQTKPQFEEKKKRAKDKCDSETLYNFVSNVRESILRLQTSVEKSEDHLSSRSQSILDSLETVAKTLQETIQAQNDLVFEAVQDKGNMEQAILEMKKRFEARQGEFIEMKSNLKHLEVLVAQQSQEFQQLCEQLGQLNVPSVLAELKRLISVPPVKDSASQTSPPLAQSLNLTRQEKYTSEKPVLWQAQALPAAWNPGMGSLQPGEFDVWGEGAKNDDLQEEAALPAFGSHERNRHVKDKVVQTNCKNWAVTKTGAKNHGSSVPGHKIPSDRDLVSQGASQLTSLEINFSTSIKNACQKYQAQSMFLCDPREHLVIKQKDGTVEMRGKDKKQQPRKAHRAHRGRLIASKQKQIPIQTCKFNSKYQSPQPAISVPQSPFLGQQEPRAQPLHLQCPRSPRKPVCPILGGTVMPNKTVRAVQGRLLQLSRCSSQDNWLLSSSSQGDHQMSWFSDLNLGCSETPLCKEAGKNLLYDLGFDSSDDDGF

SEQ ID NO: 11295 - protein, 203 aa, Homo sapiens
MNFNVWNIKEMLSIPSGSGNKKSSNWNNNQNDYSSLSDSQFLFGSQFCPENSETLSAPLDFGAHLRHSKQSQQNYLEGEPSIFTKYQTKPQLFGGDIKDGGLFPPPLSVGKSKGLLEQFEEKKKRAKDKCDSCRRLWKSLRTISVQEANLFWILWRLWPRHVSASCLRYQQRALVNDEHELSDPSLVSSGEVPHRVSDERMGI

SEQ ID NO: 11296 - protein, 594 aa, Homo sapiens; identical to SEQ ID NO: 11293

SEQ ID NO: 11297 - protein, 193 aa, Homo sapiens
MLSTPKSQGNKKSSNWNNNQNDYSSLSDSQFLFGSQFCPENSETLSAPLDFGAHLRHSKQSQQNYLEGEPSIFTKYQTKPQLFGGDIKDGGLFPPPLSVGKSKGLLEQFEEKKKRAKDKCDSCRRLWKSLRTISVQEANLFWILWRLWPRHVSASCLRYQQRALVNDEHELSDPSLVSSGEVPHRVSDERMGI

SEQ ID NO: 11298 - protein, 594 aa, Homo sapiens; identical to SEQ ID NO: 11293

SEQ ID NO: 11299 - protein, 611 aa, Homo sapiens
MSEIPSTIVSKNMTNDKNSLESMNISSSSSTEENPKKQARKNEEHGPDPSANPFHLSGDVDFFLLRDQERNKALSERQQQKTMRVHQKMTYSSKVSAKHTSLRRQLQLEDKQEDLEARAEAEHQRAFRDYTTWKLTLTKEKNVEPENMSGYIKQKRQMFLLQYALDVKRREIQRLETLATKEEARLERAEKSLEKDAALFDEFVRENDCSSVQAMRAAEKETKAKIEKILEIRDLTTQIVNIKSEISRFEDTLKHYKVYKDFLYKLSPKEWLEEQEKKHSFLKKAKEVSEASKESSVNSTPGDKGPGIKGKASSMWAKEGQGTKKPWRFLQTMRLGRSPSYLSSPQQGSQPSESSGGDSRGSNSPIPPTQEDTDSDGEEPQLYFTEPQQLLDVFRELEEQNLSLIQNSQETEKTLEELSHTLKHTQIRMDREVNQLKQWVTTMMMSITKEEDTAAELELKARVFHFGEYKGDQQDKLLESLNCKVLDVYRHCTGTQQEANLGTVQMLTIIEHQLDELLENLEHVPQVKIEQAERAKEKERRIRLREEKLQMQKILQEEHLQRARARAQAEIKKKRGRTLVCRSRPPAHRIKQQSEHTLMDKEEEELLFFFT

SEQ ID NO: 11300 - protein, 612 aa, Homo sapiens
MSEIPSTIVSKNMTNDKNSLESMNISSSSSTEENPKKQARKNEEHGPDPSANPFHLSGDVDFFLLRDQERNKALSERQQQKTMRVHQKMTYSSKVSAKHTSLRRQLQLEDKQEDLEARAEAEHQRAFRDYTTWKLTLTKAEKNVEPENMSGYIKQKRQMFLLQYALDVKRREIQRLETLATKEEARLERAEKSLEKDAALFDEFVRENDCSSVQAMRAAEKETKAKIEKILEIRDLTTQIVNIKSEISRFEDTLKHYKVYKDFLYKLSPKEWLEEQEKKHSFLKKAKEVSEASKESSVNSTPGDKGPGIKGKASSMWAKEGQGTKKPWRFLQTMRLGRSPSYLSSPQQGSQPSESSGGDSRGSNSPIPPTQEDTDSDGEEPQLYFTEPQQLLDVFRELEEQNLSLIQNSQETEKTLEELSHTLKHTQIRMDREVNQLKQWVTTMMMSITKEEDTAAELELKARVFHFGEYKGDQQDKLLESLNCKVLDVYRHCTGTQQEANLGTVQMLTIIEHQLDELLENLEHVPQVKIEQAERAKEKERRIRLREEKLQMQKILQEEHLQRARARAQAEIKKKRGRTLVCRSRPPAHRIKQQSEHTLMDKEEEELLFFFT

SEQ ID NO: 11301 - protein, 563 aa, Homo sapiens
MSSNLLPTLNSGGKVKDGSTKEDRPYKIFFRDLFLVKENEMAAKETEKFMNRNMKVYQKTTFSSRMKSHSYLSQLAFYPKRSGRSFEKFGPGPAPIPRLIEGSDTKRTVHEFINDQRDRFLLEYALSTKRNTIKKFEKDIAMRERQLKKAEKKLQDDALAFEEFLRENDQRSVDALKMAAQETINKLQMTAELKKASMEVQAVKSEIAKTEFLLREYMKYGFFLLQMSPKHWQIQQALKRAQASKSKANIILPKILAKLSLHSSNKEGILEESGRTAVLSEDASQGRDSQGKPSRSLTRTPEKKKSNLAESFGSEDSLEFLLDDEMDVDLEPALYFKEPEELLQVLRELEEQNLTLFQYSQDVDENLEEVNKREKVIQDKTNSNIEFLLEQEKMLKANCVREEEKAAELQLKSKLFSFGEFNSDAQEILIDSLSKKITQVYKVCIGDAEDDGLNPIQKLVKVESRLVELCDLIESIPKENVEAIERMKQKEWRQKFRDEKMKEKQRHQQERLKAALEKAVAQPKKKLGRRLVFHSKPPSGNKQQLPLVNETKTKSQEEEYFFT

SEQ ID NO: 11302 - protein, 701 aa, Homo sapiens
MVVSTFTDMDTFPNNFPPGGDSGLTGSQSEFQKMLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGLQSDNEILKAAVEHHKVLLVEKDRELIRKVQAAKEEGYQKLVVLQDEKLELENRLADLEKMKVEHDVWRQSEKDQYEEKLRASQMAEEITRKELQSVRLKLQQQIVTIENAEKEKNENSDLKQQISSLQIQVTSLAQSENDLLNSNQMLKEMVERLKQECRNFRSQAEKAQLEAEKTLEEKQIQWLEEKHKLHERITDREEKYNQAKEKLQRAAIAQKKRKSLHENKLKRLQEKVEVLEAKKEELETENQVLNRQNVPFEDYTRLQKRLKDIQRRHNEFRSLILVPNMPPTASINPVSFQSSAMVPSMELPFPPHMQEEQHQRELSLLRKRLEELETTQRKQLEELGSSGE

SEQ ID NO: 11303 - protein, 568 aa, Homo sapiens
MLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGLQSDNEILKAAVEHHKVLLVEKDRELIRKVQAAKEEGYQKLVVLQDEKLELENRLADLEKMKVEHDVWRQSEKDQYEEKLRASQMAEEITRKELQSVRLKLQQQIVTIENAEKEKNENSDLKQQISSLQIQVTSLAQSENDLLNSNQMLKEMVERLKQECRNFRSQAEKAQLEAEKTLEEKQIQWLEEKHKLHERITDREEKYNQAKEKLQRAAIAQKKLEQDLELGCPSVTDTYRESVFPPPPLKRDLLK

SEQ ID NO: 11304 - protein, 701 aa, Homo sapiens; identical to SEQ ID NO: 11302

SEQ ID NO: 11305 - protein, 2 aa, Homo sapiens
MV

SEQ ID NO: 11306 - protein, 316 aa, Homo sapiens
MSLGIMEEEDLAEYFRLQYGERLLQMLQKLPNVEGASESPSIWLLEKKKETEIMHQTMVQKKKMFQRRMETLNLRWEELGVKEAQLKAHIQKSEQFIQENDQKRIRAMKKANKERELKCQHMQELTKRKQEMVALRLEHQRLSAKLKDYYIFNKYLEKVVENSEFEEIHEVIARYKTLVSMRHDLMQSAQEGQEKIERAKARLARYMEEKDDEILQQNNELARLQMRFDRARSNVIFWESRWAHIQNTAAKKTLLLGTIKMATLNLFQIVSKHLKEVTEVALEDTHKQLDMIQQFIQDRSDIWAEVKKKEQQRVRI

SEQ ID NO: 11307 - protein, 242 aa, Homo sapiens
MSLGIMEEEDLAEYFRLQYGERLLQMLQKLPNVEGASESPSIWLLEKKKETEIMHQTMVQKKKMFQRRMETLNLRWEELGVKEAQLKAHIQKSEQFIQENDQKRIRAMKKANKERELKCQHMQELTKRKQEMVALRLEHQRLSAKLKDYYIFNKYLEKVVENSEESRWAHIQNTAAKKTLLLGTIKMATLNLFQIVSKHLKEVTEVALEDTHKQLDMIQQFIQDRSDIWAEVKKKEQQRVRI

SEQ ID NO: 11308 - protein, 308 aa, Homo sapiens
MAVPWEEYFRLALQEKLSTKLPEQAEDHVPPVLRLLEKRQELVDADQALQAQKEVFRTKTAALKQRWEQLEQKERELKGSFIRFDKFLQDSEARRNRALRRAAEERHQAGRREVEALRLWTQLQELRREHARLQRRLKRLEPCARLLEQALELLPGFQEVPELVARFDGLAETQAALRLREREQLAELEAARARLQQLRDAWPDEVLAQGQRRAQLQERLEAARERTLQWESKWIQIQNTAAEKTLLLGRSRMAVLNLFQLVCQHQGQPPTLDIEDTEGQLEHVKLFMQDLSAMLAGLGQAEPAAPAS

SEQ ID NO: 11309 - protein, 224 aa, Homo sapiens
MAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDEADEKDDSGATTMNIGSDKLLFRNTNVEDVLNARKLERDSLRDESQRKKEQDKLQRERDKLAKQERKEKEKKRTQRGERKR

SEQ ID NO: 11310 - protein, 154 aa, Homo sapiens
MAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDSVPKHQCGRCP

SEQ ID NO: 11311 - protein, 161 aa, Homo sapiens
MTYFGHFGGANHAHTLGELEACIAMLVEQLRTQGCGGRTLGTSEEEAELQQKVEENEHLRLELQMVETERVRLSLLEEKLVDVLQLLQRLRDLNISKRALGKILLSTLDAFRDPTHEGRPSPAAILDALHQALAACQLLRRQPSAPASAAAALTNPLLVSC

SEQ ID NO: 11312 - protein, 328 aa, Homo sapiens
MYTLHTKRVKAAARQMWTSNLSKVRQSLKNVYHKCKIRHQDSTGYPTVTSDDCNQDDDSYDGKMNLPVVLQDVKTAQVELFSQMTDIVHMIPKVQEKTDLYQKQMEVLETRMNVNEDKQCTTTKDILSMKEDIKALKKKVTELEIQNSCSTIHCLEILEGERGKEITELLYKLIQPATLKNTLASTDMEISSAEPEKVPSYPKSTDHLEKKTISPQMKTLKKRNHQNASRSFEKAKPNIYIYPDFSTWIKLTFVHGGKWTFFLSATKLEEFIQWLLSRPTILPEEPQVITQRYCPFTGPILSLTTICLSIFNNIYGFICSLKEEVTRL

SEQ ID NO: 11313 - protein, 301 aa, Homo sapiens
MGNRLRAELGRPERWLLHHALPPAPEARKPGEEPRRPLDRSPPLGQVQPHFTSQDAKSAEDEAPSRHLGKHQPRSAQVGSRLDALQGPKTQHSIHTVTCKSPRQKEDRSPKPPQAPQHPEEHGRQSHSSSSFASGTLQDMWRLLDLGSSPSGVTSQGDSTPEMGSHYVTQAGLELLGSSSPAALASQSAEMTGVGPTPSLAWSGALHPNMNQEASLVRSTWAPGMRGGMNGGSSSVCKNMQRGPHWSPSQQPCSGIRTVLLSRKERTLLSCFSLPAPVVLVPLLLSGQAVTERAGHAGDIL

SEQ ID NO: 11314 - protein, 916 aa, Homo sapiens
MLPLGSEPALNELLLRKEEEWRALQAHRTQLQEAALQDTRSQLEEAQGKLRCLQEDFVYNLQVLEERDLELERYDAAFAQAREWEEARRAEVSELKIEAAKLRQALAREARKVEELQQQQQLAFQEHRLELERVHSDKNGEIDHHREQYENLKWTLERKLEELDGELALQRQELLLEFESKMRKREHEFRLQADNMSNTALSRELKVKLLHKELEALKEAGAKAAESLQRAEATNAELERKLQSRAGELQDLEAMSRARVKDLEDKLHSVQLTRKKEEETFKRKHEELDRLAREKDAVLVAVKGAHVEQLQELQTRVLELQAHCETLEAQLRRAEWRQADTAKEKDAAIDQLREDASTVKSAWDAQIAQLSKEMVSRDLQIQTLQEEEVKLKAQVARSQQDIERYKQQLSLAVERERSLERDQVQLGLDWQRRCDDIERDQIQKSEALIQGLSMAKSQVAAKLQETEQALQEQEVVLKAVTLERDQAVQALRMHGLPRPGAQMLLRQHEEEISKDFPSSEIQRLREQNTSLRNAIAQMRKEMEALSHQIPPPIQTAAESTDANQPDPEAGGDAATPDYVLALEAEIRTLKHKFKTLEKHLEDVLDPLKMSSPHAESQPSVRTSTETTGGSAQAGQAGGSVQAGQAGGSVQAGPVSSGLALRKLGDRVQLLNLLVTRLRQKVLREPLEPAALQRELPREVDQVHLEVLELRKQVAELGKHLRIAQHGGAEPSGRKQPPASDAVALGREQDAKSAEDEAPSRHLGKHQPRSAQVGSRLDALQGPKTQHSIHTVTCKSPRQKEDRSPKPPQAPQHPEEHGRQSHSSSSFASGTLQDMWRLLDLGSSPSGVTSQGDSTPELPAPPAADRRPVKMQAGIATPGMKTAAQAKAKTTGASRSHPAKAKGCQRPPKIRNYNIMD

SEQ ID NO: 11315 - protein, 916 aa, Homo sapiens; identical to SEQ ID NO: 11314

SEQ ID NO: 11316 - protein, 550 aa, Homo sapiens
MTKVPATKKLQSSPNSGAVRPFYASENLRQVPDKPMKSIKYMDKEIINLKKDLIRSRFLIQSVKIGRGYFAILREETAKKKKQQQLQKLKEEERNKFQPAEKISEIHYGDTLLSTYDDEKLKTLGARVTRRPFTPIHSCIISPSLTEAHVEPLFRQLCALHWLLEALTIDHTHHTMKPVITCWNPKDPGGSKSTIKKINKDKSMGQKWEHFITAPKTKKFKIPTMRVTNRKPSRRGSTLSLSRASGGSSPQSSMISVNPGSDEPPSVNTQVTSSKDIEDNESSSTKPDEEPLYMNLQKLLEMVREDARRTVTIENGMQRKAPSILSVLKQNKSNSAYKEMQTTLKSSERSSSTSAESHIQPVQKKSKNRTNCDINIHYKSGVCNTMRAKFYSVAQEAGFCLQDKMEILMKRQEERGIQKFRAFVLVSNFQKDIAKMRHHISVVKGDAEEIADHWYFDLLSKLPEDLKNFRPAKKILVKLQKFGENLDLRIRPHVLLKVLQDLRIWELCSPDIAVAIEFVREHIIHMPQEDYISWLQSRINIPIGPYSALR

SEQ ID NO: 11317 - protein, 563 aa, Homo sapiens
MSVLKKNRRKDSDTPQEPSEKAKEQQAEAELRKLRQQFRKMVESRKSFKFRNQQKIASQYKEIKTLKTEQDEITLLLSLMKSSRNMNRSEKNYMELRLLLQTKEDYEALIKSLKVLLAELDEKILQMEKKIANQKQIFAKMQEANNPRKLQKQIHILETRLNLVTVHFDKMLTTNAKLRKEIEDLRFEKAAYDNVYQQLQHCLLMEKKTMNLAIEQSSQAYEQRVEAMARMAAMKDRQKKDTSQYNLEIRELERLYAHESKLKSFLLVKLNDRNEFEEQAKREEALKAKKHVKKNRGESFESYEVAHLRLLKLAESGNLNQLIEDFLAKEEKNFARFTYVTELNNDMEMMHKRTQRIQDEIILLRSQQKLSHDDNHSVLRQLEDKLRKTTEEADMYESKYGEVSKTLDLLKNSVEKLFKKINCDATKILVQLGETGKVTDINLPQYFAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 11318 - protein, 508 aa, Homo sapiens
MSSPDGPSFPSGPLSGGASPSGDEGFFPFVLERRDSFLGGGPGPEEPEDLALQLQQKEKDLLLAAELGKMLLERNEELRRQLETLSAQHLEREERLQQENHELRRGLAARGAEWEARAVELEGDVEALRAQLGEQRSEQQDSGRERARALSELSEQNLRLSQQLAQASQTEQELQRELDALRGQCQAQALAGAELRTRLESLQGENQMLQSRRQDLEAQIRGLREEVEKGEGRLQTTHEELLLLRRERREHSLELERARSEAGEALSALRRLQRRVSELEEESRLQDADVSAASLQSELAHSLDDGDQGQGADAPGDTPTTRSPKTRKASSPQPSPPEEILEPPKKRTSLSPAEILEEKEVEVAKLQDEISLQQAELQSLREELQRQKELRAQEDPGEALHSALSDRDEAVNKALELSLQLNRVSLERDSLSRELLRAIRQKVALTQELEAWQDDMQVVIGQQLRSQRQKELSASASSSTPRRAAPRFSLRLGPGPAGGFLSNLFRRT

SEQ ID NO: 11319 - protein, 914 aa, Homo sapiens
MGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQCEQKIAIENEWKPADIFSTLGERECDRSSLEAKKAQWRKELDEQVALKKKEKEVSEKWNDPWKKSESDKIIWEKHQILDQSRETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMNTYMNSTTSKKDTGVQTDDLNIGIFTNAESHCGSLMERDITNCSSPEISAELIGQFSTKKNKQELTQDKGASLEKENNRCNDQCNQFTRIEKQTKHMKKYPKRPDWNINKPPKRYIPASEKYPKQLQKQREEKKVRRQMELLHLVEKNNPGHLSQNRGISPEIFHSSHQETESKLRWHLVKKEEEPLNIHSFSKERSPSSPVPVVKNRTQQTQNTLHLPLKNSSYERENLISGSNQTELSSGISESSHFIPYVRTNEIYYLDPDAPLSGPSTQDPQYQNSQDCGQKRQLFDSDCVRDPLLNPNMVKNRDRQQAILKGLSELRQGLLQKQKELESSLLPLAENQEESFGSSF

SEQ ID NO: 11320 - protein, 948 aa, Homo sapiens
MNLGDGLKLETELLDGKTKLILSPYEHKSKISVKMGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQCEQKIAIENEWKPADIFSTLGERECDRSSLEAKKAQWRKELDEQVALKKKEKEVSEKWNDPWKKSESDKIIWEKHQILDQSRETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMNTYMNSTTSKKDTGVQTDDLNIGIFTNAESHCGSLMERDITNCSSPEISAELIGQFSTKKNKQELTQDKGASLEKENNRCNDQCNQFTRIEKQTKHMKKYPKRPDWNINKPPKRYIPASEKYPKQLQKQREEKKVRRQMELLHLVEKNNPGHLSQNRGISPEIFHSSHQETESKLRWHLVKKEEEPLNIHSFSKERSPSSPVPVVKNRTQQTQNTLHLPLKNSSYERENLISGSNQTELSSGISESSHFIPYVRTNEIYYLDPDAPLSGPSTQDPQYQNSQDCGQKRQLFDSDCVRDPLLNPNMVKNRDRQQAILKGLSELRQGLLQKQKELESSLLPLAENQEESFGSSF

SEQ ID NO: 11321 - protein, 948 aa, Homo sapiens
MDLLDGLKLETELLDGKTKLILSPYEHKSKISVKMGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQCEQKIAIENEWKPADIFSTLGERECDRSSLEAKKAQWRKELDEQVALKKKEKEVSEKWNDPWKKSESDKIIWEKHQILDQSRETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMNTYMNSTTSKKDTGVQTDDLNIGIFTNAESHCGSLMERDITNCSSPEISAELIGQFSTKKNKQELTQDKGASLEKENNRCNDQCNQFTRIEKQTKHMKKYPKRPDWNINKPPKRYIPASEKYPKQLQKQREEKKVRRQMELLHLVEKNNPGHLSQNRGISPEIFHSSHQETESKLRWHLVKKEEEPLNIHSFSKERSPSSPVPVVKNRTQQTQNTLHLPLKNSSYERENLISGSNQTELSSGISESSHFIPYVRTNEIYYLDPDAPLSGPSTQDPQYQNSQDCGQKRQLFDSDCVRDPLLNPNMVKNRDRQQAILKGLSELRQGLLQKQKELESSLLPLAENQEESFGSSF

SEQ ID NO: 11322 - protein, 287 aa, Homo sapiens
MDLLDGLKLETELLDGKTKLILSPYEHKSKISVKMGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQCEQKIAIENEWKPADIFSTLGERECDRSSLEAKKAQWRKELVLQTVQAWYQHLLGFW

SEQ ID NO: 11323 - protein, 604 aa, Homo sapiens
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMSMDFTNREQSRHTSINKLQYENERLRNDLAKLHVNGKSTWTNQNTYEETGRYAYQSQIKVEQNEERLSHDCEPNRSTMPPLPPSTFQAKEMTSPLVSDDDVFPLSPPDMSFPASLAAQHFLLEEEKRAKELEKLLNTHIDELQRHTEFTLNKYSKLKQNRHI

SEQ ID NO: 11324 - protein, 329 aa, Homo sapiens
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIK

SEQ ID NO: 11325 - protein, 604 aa, Homo sapiens; identical to SEQ ID NO: 11323

SEQ ID NO: 11326 - protein, 335 aa, Homo sapiens
MTTVTVTTEIPPRDKMEDNSALYESTSAHIIEETEYVKKIRTTLQKIRTQMFKDEIRHDSTNHKLDAKHCGNLQQGSDSEMDPSCCSLDLLMKKIKGKDLQLLEMNKENEVLKIKLQASREAGAAALRNVAQRLFENYQTQSEEVRKKQEDSKQLLQVNKLEKEQKLKQHVENLNQVAEKLEEKHSQITELENLVQRMEKEKRTLLERKLSLENKLLQLKSSATYGKSCQDLQREISILQEQISHLQFVIHSQHQNLRSVIQEMEGLKNNLKEQDKRIENLREKVNILEAQNKELKTQVALSSETPRTKVSKAVSTSELKTEGVSPYLMLIRLRK

SEQ ID NO: 11327 - protein, 335 aa, Homo sapiens; identical to SEQ ID NO: 11326

SEQ ID NO: 11328 - protein, 335 aa, Homo sapiens; identical to SEQ ID NO: 11326

SEQ ID NO: 11329 - protein, 296 aa, Homo sapiens
MGCRHSRLSSCKPPKKKRQEPEPEQPPRPEPHELGPLNGDTAITVQLCASEEAERHQKDITRILQQHEEEKKKWAQQVEKERELELRDRLDEQQRVLEGKNEEALQVLRASYEQEKEALTHSFREASSTQQETIDRLTSQLEAFQAKMKRVEESILSRNYKKHIQDYGSPSQFWEQELESLHFVIEMKNERIHELDRRLILMETVKEKNLILEEKITTLQQENEDLHVRSRNQVVLSRQLSEDLLLTREALEKEVQLRRQLQQEKEELLYRVLGANASPAFPLAPVTPTEVSFLAT

SEQ ID NO: 11330 - protein, 202 aa, Homo sapiens
MRTSMSEAATRWSCQGSCQKTCFSRVRPWRRRCSCGDSSSRRRRSCCTGSLGPMPRLPSLWPLSLPLRSLSSPHRVQGLGPPRRLKSQLLPRFFWRRQQEPLSSFPGRNEGGSEMEILGVCPVSPGALSYMESPTGFWRPREASSLELAKGISKRRHFLPAPALCPNPRSSEAFPGQSVSRWPFDIKETAPGPSLSALLPTC

SEQ ID NO: 11331 - protein, 486 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERAVNDQVLLDAEYKQMQCDFQLLSEEKLVLENELQKLKDKEKTKPTNNRTKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQITAQSGRLIEKRC

SEQ ID NO: 11332 - protein, 279 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNVCILYILSIFLKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPRKFPLIKAL

SEQ ID NO: 11333 - protein, 486 aa, Homo sapiens; identical to SEQ ID NO: 11331

SEQ ID NO: 11334 - protein, 160 aa, Homo sapiens
KTKPTNNRTKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQMLIEFLKYFGKVSQTFRE

SEQ ID NO: 11335 - protein, 171 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEG

SEQ ID NO: 11336 - protein, 175 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEKLLIQ

SEQ ID NO: 11337 - protein, 173 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEESCK

SEQ ID NO: 11338 - protein, 171 aa, Homo sapiens; identical to SEQ ID NO: 11335

SEQ ID NO: 11339 - protein, 467 aa, Homo sapiens
MSVVVQHVEEKAVHSWSRISTAGKKALEEALLVFNPMSQDLSATEAQLVAFLQGLRDDGFQPTILRSGDVYGYSSCTANPPSQTKLQARAPNPTATSPPASAPRTAMRLPAGRATLLPMPLSGRLAKASTPALAKHATTNLLLSSLKQSSASHARGAAVGFPTHLYPGVYPAMRLSVVLEALVPLKTPMPCLGAKHKAQSLQLSLADSPLKLRKSSGKGPGNPRPKAPRKTTSKGPKCLTRKGPGAGPRRGSGHQSKTNRATGSPSVRRMKGGSALGTKTAQAKVARTLAKAARAQAKVARTQAKAAKARAKAKAAQVKAKAKAKAAQVKAKAKVMAAWAKAKAKAKAVRAKAKVARTQPRGRGRPKGSAKARTTRKGQKNRPETVGQKRKRAEEAKDLPPKKRTRLGPRSPKAWLGPGTAKLLKFRAIKVDRRSSDDEVRQRAQRILRVNLSPVIRLQPLLPYSAV

SEQ ID NO: 11340 - protein, 235 aa, Homo sapiens
MRRSMKRRRRRRPVAPATAARGGDFRAEDGAGLEAREEKVVYSRSQLSLADSTKALGDAFKLFMPRSTEFMSSDAELWSFLCSLKHQFSPHILRSKDVYGYSSCRALVPDPPGPPTARGQARRPVPRAAARRRRRGARAAAARRRKPRPPPPPPPPPEESCPAKPVAPGPCFGGRTLEEIWRAATPTLTTFPTIRVGSDVWGERSLAAARRRARQVLRVNLEPMVRLRRFPVPRA

SEQ ID NO: 11341 - protein, 64 aa, Homo sapiens
MSGREGGKKKPLKQPKKQAKEMDEEDKAFKQKQKEEQKKLEELKAKAAGKGPLATGGIKKSGKK

SEQ ID NO: 11342 - protein, 378 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDGPSGNHLSRASAPLGARWVCINGVWVEPGGPSPARLKEGSSRTHRPGGKRGRLAGGSADTVRSPADSLSMSSFQSVKSISNSGKARPQPGSFNKQDSKADVSQKADLEEEPLLHNSKLDKVPGVQGQARKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 11343 - protein, 330 aa, Homo sapiens
MGRNPWDSPCPARSLPQIAAVARPRISSPMALSPHMLGAQGLWTHSIQGSLPAIWAATMGTKGGSRVLFPCHLSKALPHPDSGPHPAQDPGLWSQAHFPLSLGLGLTSGGHLTGGWSQPGNIAAGAVPRALPSQGDMEKGVEGGPFPSRCGNSSELFWAKCGPSRQPQPCSAGDADRTREEAMLSLGTCCSMCPKPSCFPDGPSGNHLSRASAPLGARWVCINGVWVEPGGPSPARLKEGSSRTHRPGGKRGRLAGGSADTVRSPADSLSMSSFQSVKSISNSGKARPQPGSFNKQDSKADVSQKADLEEEPLLHNSKLDKVPGVQGQAR

SEQ ID NO: 11344 - protein, 312 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDSLSMSSFQSVKSISNSGKARPQPGSFNKQDSKADVSQKADLEEEPLLHNSKLDKVPGVQGQARKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 11345 - protein, 380 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDGPSGNHLSRASAPLGARWVCINGVWVEPGGPSPARLKEGSSRTHRPGGKHGRLAGGSADTVRSPADSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 11346 - protein, 482 aa, Homo sapiens
MGRNPWDSPCPARSLPQIAAVARPRISSPMALSPDMLGAQGLWTHSIQGSLPAIWAATMGTKGGSRVLFPCHLSKALPHPDSGPHPAQDSGLWSRAHFPLSLGLGLTSGGHLTGGWSQPGNIVAGAVPRALPSQRDMENGVEGGPFPSRCGNSSELFWAKCGPSRQPQPCSAGDADRTREEAMLSLGTCCSMCPKPSCFPDGPSGNHLSRASAPLGARWVCINGVWVEPGGPSPARLKEGSSRTHRPGGKHGRLAGGSADTVRSPADSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 11347 - protein, 314 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 11348 - protein, 205 aa, Homo sapiens
  MOD_RES (1)..(1): Any amino acid
XSGAGVAAGTRPPSSPTPGSRRRRQRPSVGVQSLRPQSPQLRQSDPQKRNLDLEKSLQFLQQQHSEMLAKLHEEIEHLKRENKGEPARGPRPALPPQAHSTLPLPQHRNTAINSSTRLGSGGTQDDLRYKLIMNQTSQKKDGPSGNHLSRASAPLGARWVCINGVWVEPGGPSPARLKEGSSRTHRPGGKHGRLAGGSADTVRSP

SEQ ID NO: 11349 - protein, 156 aa, Homo sapiens
MSRKSGIGHEASLKRKAEEKLESYRKKIHMKNQAEEKAAEQFRMRLKNKQDEMKLEGDLRRSQRACQQLDVQKNIQVPREAWYWLRLEEETEEDEEEKEQDEDEYKSEDLSVLEKLQILTSYLREEHLYCIWCGTAYEDKEDLSSNCPGPTSADHD

SEQ ID NO: 11350 - protein, 259 aa, Homo sapiens
MAEEEDYMSDSFINVQEDIRPGLPMLRQIREARRKEEKQQEANLKNRQKSLKEEEQERRDIGLKNALGCENKGFALLQKMGYKSGQALGKSGGGIVEPIPLNIKTGKSGIGHEASLKRKAEEKLESYRKKIHMKNQAEEKAAEQFRMRLKNKQDEMKLEGDLRRSQRACQQLDVQKNIQVPREAWYWLRLEEETEEDEEEKEQDEDEYKSEDLSVLEKLQILTSYLREEHLYCIWCGTAYEDKEDLSSNCPGPTSADHD

SEQ ID NO: 11351 - protein, 130 aa, Homo sapiens
MVVAAGKRFCGEHAGAAEEEDARKRILCPLDPKHTVYEDQLAKHLKKCNSREKPKPDFYIQDINAGLRDETEIPEQLVPISSLSEEQLEKLIKKLRKASEALHDALNDPKNGDSATKHLKQQVCLGYSNY

SEQ ID NO: 11352 - protein, 481 aa, Homo sapiens
MATSATSPHAPGFPAEGRCGYYVEKKKRFCRMVVAAGKRFCGEHAGAAEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQASILGNIENLKLLGPRRCFVEFGAGKGKLSHWVDIALKDAEKVHFILVEKVTTRFKVDGKHRKKNSVFERLQIDIQHLCLNKIPVLREEKLPVVGIGKHLCGMATDLALRCLVETYAASFEERNEEPLAKRIKNDKTEKEIYTLAKEGNEKNVPEKWNPVAGIVIALCCHHRCDWRHYVGKEYFRALGLGAVEFHYFQRMSSWATCGMRKTSLETSNSTTKRQDNQNDDSEEHDDGGYRITDDGADCLPGLLSVEEKKKIGHLCKLLIDQGRIQYLQQKGFSPALQYYTDPLVSLENVLLTALPNHSSSPETTA

SEQ ID NO: 11353 - protein, 109 aa, Homo sapiens
MATSATSPHAPGFPAEGRCGYYVEKKKRFCRMVVAAGKRFCGEHAGAAEEEDARKRILCPLDPKHTVYEDQLAKHLKKCNSREKPKPDFYIQDINAGLRDETEIPEQLA

SEQ ID NO: 11354 - protein, 438 aa, Homo sapiens
MEHAATTGPRPGPPSRRVENVVLRAKDWLPGAPGGTAVWATSLEAEVPPDLALNKEQQLQISKELVDIQITTHHLHEQHEAEIFQLKSEILRLESRVLELELRGDGTSQGCAVPVESDPRHPRAAAQELRHKAQVPGHSDDHRFQVQPKNTMNPENEQHRLGSGLQGEVKWALEHQEARQQALVTRVATLGRQLQGAREEARAAGQRLATQAVVLCSCQGQLRQAEAENARLQLQLKKLKDEYVLRLQHCAWQAVEHADGAGQAPATTALRTFLEATLEDIRAAHRSREQQLARAARSYHKRLVDLSRRHEELLVAYRAPGNPQAIFDIASLDLEPLPVPLVTDFSHREDQHGGPGALLSSPKKRPGGASQGGTSEPQGLDAASWAQIHQKLRDFSRSTQSWNGSGHSCWSGPRWLKSNFLSYRSTWTSTWAGTSTKS

SEQ ID NO: 11355 - protein, 287 aa, Homo sapiens
MHSVAHPHPGVPPWVPATLIITGKRRGAAAGGAGLEHGGSGRAHLREVSAETWRTRGVGAGRLVTGPALASGPPCSQLYNGQGSPRTISWGLGHTRVGVASLLMLESLSGLALWFSPPPAASRPPGPGLSLYTDGSKAWGAPQEHGGAHASLTHSQVSPPGSGNLTQHGHVCPCVTMPALKTTPPFLSPHRGLDAASWAQIHQKLRDFSRSTQVGGKGWPRPILTPCPSSWLTSPCQAELERERAQLLVRATMAEEQLSELQEYVDQHLGRWAEGAGCDPRALVWLE

SEQ ID NO: 11356 - protein, 508 aa, Homo sapiens
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFLSNDSNINLKRMSVYVILVLVSNNRTGQTLVRETGCITVLSRLFRTVISKHELDLSDKNVFQSYQLWSSVCSTLCVCVNNPQNDENQMFCCSLFPHANEWLKNCTTPEIIRPICSFIGLTLANNTYVQKYFVSVGGLDVLSQVLMQLESDSHETLSSAKLAVVVTKTVDACIADNPTFGIVLSKYHIVSKLLALLLHESLDSGEKFSIMLTLGHCTEDCAEKLSLSLGEYPFDENETQQLKDISVKENNLEEHWRKAKEILHRIEQLEREGNEEEIQRENYQDNISSMNISIQNTWKHLHADRIGRGSKAEDEDKSHSRQLQSYKSHGVMSKACTNDDQMKTPLKSANPVHACYRESEQNKTLYKAKSSCNQNLHEETTFEKNFVSQSRSIYIMFRYNK

SEQ ID NO: 11357 - protein, 680 aa, Homo sapiens
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFLSNDSNINLKRMSVYVILVLVSNNRTGQTLVRETGCITVLSRLFRTVISKHELDLSDKNVFQSYQLWSSVCSTLCVCVNNPQNDENQMFCCSLFPHANEWLKNCTTPEIIRPICSFIGLTLANNTYVQKYFVSVGGLDVLSQVLMQLESDSHETLSSAKLAVVVTKTVDACIADNPTFGIVLSKYHIVSKLLALLLHESLDSGEKFSIMLTLGHCTEDCEENQYDLFKNNGLPLMIQALTESQNEELNKAATFVLHNCKKITEKLSLSLGEYPFDENETQQLKDISVKENNLEEHWRKAKEILHRIEQLEREGNEEEIQRENYQDNISSMNISIQNTWKHLHADRIGRGSKAEDEDKSHSRQLQSYKSHGVMSKACTNDDQMKTPLKSANPVHACYRESEQNKTLYKAKSSCNQNLHEETTFEKNFVSQSRYSLIIVCCIAVEKSLNSRNFSKLLHSCPYQCDRHKVIVEAEDRYKSELRKSLICNKKILLTPRRRQRLSNESTTPGGIKKRRIRKNFTEEEVNYLFNGVKKMGNHWNSILWSFPFQQGRKAVDLAHKYHKLTKHPTCAAS

SEQ ID NO: 11358 - protein, 727 aa, Homo sapiens
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFLSNDSNINLKRMSVYVILVLVSNNRTGQTLVRETGCITVLSRLFRTVISKHELDLSDKNVFQSYQLWSSVCSTLCVCVNNPQNDENQMFCCSLFPHANEWLKNCTTPEIIRPICSFIGLTLANNTYVQKYFVSVGGLDVLSQVLMQLESDSHETLSSAKLAVVVTKTVDACIADNPTFGIVLSKYHIVSKLLALLLHESLDSGEKFSIMLTLGHCTEDCEENQYDLFKNNGLPLMIQALTESQNEELNKAATFVLHNCKKITEKLSLSLGEYPFDENETQQLKDISVKENNLEEHWRKAKEILHRIEQLEREGNEEEIQRENYQDNISSMNISIQNTWKHLHADRIGRGSKAEDEDKSHSRQLQSYKSHGVMSKACTNDDQMKTPLKSANPVHACYRESEQNKTLYKAKSSCNQNLHEETTFEKNFVSQSSDHVFKHPVHIAKNIKQQLPVTDPFTLCSDIINKEVVSFLATPSCSEMLTYRCSGCIAVEKSLNSRNFSKLLHSCPYQCDRHKVIVEAEDRYKSELRKSLICNKKILLTPRRRQRLSNESTTPGGIKKRRIRKNFTEEEVNYLFNGVKKMGNHWNSILWSFPFQQGRKAVDLAHKYHKLTKHPTCAAS

SEQ ID NO: 11359 - protein, 550 aa, Homo sapiens
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFLSNDSNINLKRMSVYVILVLVSNNRTGQTLVRETGCITVLSRLFRTVISKHELDLSDKNVFQSYQLWSSVCSTLCVCVNNPQNDENQMFCCSLFPHANEWLKNCTTPEIIRPICSFIGLTLANNTYVQKYFVSVGGLDVLSQVLMQLESDSHETLSSAKLAVVVTKTVDACIADNPTFGIVLSKYHIVSKLLALLLHESLDSGEKFSIMLTLGHCTEDCEENQYDLFKNNGLPLMIQALTESQNEELNKAATFVLHNCKKITEKLSLSLGEYPFDENETQQLKDISVKENNLEEHWRKAKEILHRIEQLEREGNEEEIQRENYQDNISSMNISIQNTWKHLHADRIGRGSKAEDEDKSHSRQLQSYKSHGVMSKACTNDDQMKTPLKSANPVHACYRESEQNKTLYKAKSSCNQNLHEETTFEKNFVSQSRSIYIMFRYNK

SEQ ID NO: 11360 - protein, 387 aa, Homo sapiens
MENKLPMETLVEECGENRERKCKLKDQSDKEEGTRDISSPKRLRDRQALFPAKVTNVSLLEKFERSESGGKIMTPESLSYPSCLKHDSEMKPQTSPACQDHNKAGQMKSLATREQNQKNAAYNLGVAEAIRNHKNEKPEFYKSFLFDKRPLSPALNALKQEEYSRSLLKQMDNRQENEIKQRQYRELMDRLEQVQLTEELAAQRAKFLKDKMEETQCYKRALDAQIKNKPSRLPPFEPDSSEPIFGKNEGELMVEKQKREQNYMKHQLEAAANHKRKAILHQLVDQRRDLQMLQRTQREHLADRTAELERVNRVNQCLQEDWERSAAMKKQRDLEDKAFERASDKLFLLDQCEKYRRCKQCQRRTSNVGESNLWPLNKFLPGSRLLV

SEQ ID NO: 11361 - protein, 562 aa, Homo sapiens
MLDTIARALQDLGRQVLPTLPSLSQEEVSIIWGNVSEFVRRQLTLHKGVQIPAFGTFTFIRQKLEVGNNKFILIQRPVFIMVEKLVQIHGLKQNKRPGTVDSVLSSREALRKWPSSVLAFPRIELKEMENKLPMETLVEECGENRERKCKLKDQSDKEEGTRDISSPKRLRDRQALFPAKVTNVSLLEKFERSESGGKIMTPESLSYPSCLKHDSEMKPQTSPACQDHNKAGQEMCYVCLQRAQRNSLLYYSEERRREIEDERLIQQYQMLKDQEALFRHQMKSLATREQNQKNAAYNLGVAEAIRNHKNEKPEFYKSFLFDKRPLSPALNALKQEEYSRSLLKQMDNRQENEIKQRQYRELMDRLEQVQLTEELAAQRAKFLKDKMEETQCYKRALDAQIKNKPSRLPPFEPDSSEPIFGKNEGELMVEKQKREQNYMKHQLEAAANHKRKAILHQLVDQRRDLQMLQRTQREHLADRTAELERVNRVNQCLQEDWERSAAMKKQRDLEDKAFERASDKLFLLDQCEKYRRCKQCQRRTSNVGESNLWPLNKFLPGSRLLV

SEQ ID NO: 11362 - protein, 652 aa, Homo sapiens
MLDTIARALQDLGRQVLPTLPSLSQEEVSIIWGNVSEFVRRQLTLHKGVQIPAFGTFTFIRQKLEVGNNKFILIQRPVFIMVEKLVQIHGLKQNKVYTPGEIPIVPLNFVMISLEGPFNRDVVEGCVKETLLFLSRSISMKQNVEFTFKGIGVLMIRDSKVKMRFYKDFLCTMDGSGALAKALANRPGTVDSVLSSREALRKWPSSVLAFPRIELKEMENKLPMETLVEECGENRERKCKLKDQSDKEEGTRDISSPKRLRDRQALFPAKVTNVSLLEKFERSESGGKIMTPESLSYPSCLKHDSEMKPQTSPACQDHNKAGQEMCYVCLQRAQRNSLLYYSEERRREIEDERLIQQYQMLKDQEALFRHQMKSLATREQNQKNAAYNLGVAEAIRNHKNEKPEFYKSFLFDKRPLSPALNALKQEEYSRSLLKQMDNRQENEIKQRQYRELMDRLEQVQLTEELAAQRAKFLKDKMEETQCYKRALDAQIKNKPSRLPPFEPDSSEPIFGKNEGELMVEKQKREQNYMKHQLEAAANHKRKAILHQLVDQRRDLQMLQRTQREHLADRTAELERVNRVNQCLQEDWERSAAMKKQRDLEDKAFERASDKLFLLDQCEKYRRCKQCQRRTSNVGESNLWPLNKFLPGSRLLV

SEQ ID NO: 11363 - protein, 544 aa, Homo sapiens
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRRSSGRDFEDSEKESCPSSDEVDEEEEEDNYESDEDGDDYIIDDFVVQDEEGDEENKNQQGEKLTTSQLKLVKQNSLYSFSDHYTHFERVVKALLINALDESFLGTLYDGTRQKSYAKDMLTSLHYLDNRFVQPRLESLVSRSRWKEQYKERVENYSNVSIHLKNPENCSCQACGLHRYCKYSVHLSGELYNTRTMQIDNFMSHDKQVFTVGRICASRTRIYHKLKHFKFKLYQECCTIAMTEEVEDEQVKETVERIFRRSKENGWIKEKYGQLEEYLNFADYFQEEKFEL

SEQ ID NO: 11364 - protein, 544 aa, Homo sapiens; identical to SEQ ID NO: 11363

SEQ ID NO: 11365 - protein, 30 aa, Homo sapiens
MIHVRRHETRRNSKSHVPEQKSRVDWRRTK

SEQ ID NO: 11366 - protein, 262 aa, Homo sapiens
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRRSSGRDFE

SEQ ID NO: 11367 - protein, 544 aa, Homo sapiens; identical to SEQ ID NO: 11363

SEQ ID NO: 11368 - protein, 444 aa, Homo sapiens
MENSGKANKKDTHDGPPKEIKLPTSEALLDYQCQIKEDAVEQFMFQIKTLRKKNQKYHERNSRLKEEQIWHIRHLLKELSEEKAEGLPVVTREDVEEAMKEKWKFERDQEKNLRDMRMQISNAEKLFLEKLSEKEYWEEYKNVGSERHAKLITSLQNDINTVKENAEKMSEHYKITLEDTRKKIIKETLLQLDQKKEWATQNAVKLIDKGSYLEIWENDWLKKEVAIHRKEVEELKNAIHELEAENLVLIDQLSNCRLVDLKIPRYPVLHSCPTSNPRHLLLLPLESCLISARRCWRLYLTQAAGLEVPPEEMSLELPETHIEEKSELQPTEVESRDLMSSSDESTILHLSHENSIEDLQYVKIDKEENSGTEFGDTDMKYLLYEDEKDFKDYVNLGPLGVKLMSVESKKMPIHFQEKEIPVKLYKDVRSPESHITYKMMKSFL

SEQ ID NO: 11369 - protein, 413 aa, Homo sapiens
MENSGKANKKDTHDGPPKEIKLPTSEALLDYQCQIKEDAVEQFMFQIKTLRKKNQKYHERNSRLKEEQIWHIRHLLKELSEEKAEGLPVVTREDVEEAMKEKWKFERDQEKNLRDMRMQISNAEKLFLEKLSEKEYWEEYKNVGSERHAKLITSLQNDINTVKENAEKMSEHYKITLEDTRKKIIKETLLQLDQKKEWATQNAVKLIDKGSYLEIWENDWLKKEVAIHRKEVEELKNAIHELEAENLVLIDQLSNCRLVDLKIPRRLYLTQAAGLEVPPEEMSLELPETHIEEKSELQPTEVESRDLMSSSDESTILHLSHENSIEDLQYVKIDKEENSGTEFGDTDMKYLLYEDEKDFKDYVNLGPLGVKLMSVESKKMPIHFQEKEIPVKLYKDVRSPESHITYKMMKSFL

SEQ ID NO: 11370 - protein, 313 aa, Homo sapiens
MFQIKTLRKKNQKYHERNSRLKEEQIWHIRHLLKELSEEKAEGLPVVTREDVEEAMKEKWKFERDQEKNLREHYKITLEDTRKKIIKETLLQLDQKKEWATQNAVKLIDKGSYLEIWENDWLKKEVAIHRKEVEELKNAIHELEAENLVLIDQLSNCRLVDLKIPRRLYLTQAAGLEVPPEEMSLELPETHIEKSELQPTEVESRDLMSSSDESTILHLSHENSIEDLQYVKIDKEENSGTEFGDTDMKYLLYEDEKDFKDYVNLGPLGVKLMSVESKKMPIHFQEKEIPVKLYKDVRSPESHITYKMMKSFL

SEQ ID NO: 11371 - protein, 332 aa, Homo sapiens
MAPAQRCPLCRQTFFCGRGHVYSRKHQRQLKEALERLLPQVEAARKAIRAAQVERYVPEHERCCWCLCCGCEVREHLSHGNLTVLYGGLLEHLASPEHKKATNKFWWENKAEVQMKEKFLVTPQDYARFKKSMVKGLDSYEEKEDKVIKEMAAQIREVEQSRQEVVRSVLEPQAVPDPEEGSSAPRSWKGMNSQVASSLQQPSNLDLPPAPELDWMETGPSLTFIGHQDIPGVGNIHSGATPPWMIQDEEYIAGNQEIGPSYEEFLKEKEKQKLKKLPPDRVGANFDHSSRTSAGWLPSFGRVWNNGRRWQSRHQFKTEAAAMKKQSHTEKS

SEQ ID NO: 11372 - protein, 553 aa, Homo sapiens
MSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNESTLSYVRQLEARVRQLEEENRMLPQASQNRRQPPTRNSSNMEKGWGSRARRVLQWWQGCRGIGRCLPTLPGSFRLSSGADGSNSSPNSAASFSGHATPSQQPEPVVHSLKVVWRKLGDAAGSCPGIRQHLSGNQYKGPM

SEQ ID NO: 11373 - protein, 419 aa, Homo sapiens
MAKPAATAAAASEELSQVPDEELLRWSKEELARRLRRAEGEKVGLMLEHGGLMRDVNRRLQQHLLEIRGLKDVNQRLQDDNQELRELCCFLDDDRQKGRKLAREWQRFGRHAAGAVWHEVARSQQKLRELEARQEALLRENLELKELVLLLDEERAALAATGAASGGGGGGGGAGSRSSIDSQASLSGPLSGGAPGAGARDVGDGSSTSSAGSGGSPDHHHHVPPPLLPPGPHKAPDGKAGATRRSLDDLSAPPHHRSIPNGLHDPSSTYIRQLESKVRLLEGDKLLAQQAGSGEFRTLRKGFSPYHSESQLASLPPSYQDSLQNGPACPAPELPSPPSAGYSPAGQKPEAVVHAMKVLEVHENLDRQLQDSCEEDLSEKEKAIVREMCNVVWRKLGDAASSKPSIRQHLSGNQFKGPL

SEQ ID NO: 11374 - protein, 849 aa, Homo sapiens
MMEPPKPEPELQRFYHRLLRPLSLFPTRTTSPEPQKRPPQEGRILQSFPLAKLTVASLCSQVAKLLAGSGIAAGVPPEARLRLIKVILDELKCSWREPPAELSLSHKNNQKLRKRLEAYVLLSSEQLFLRYLHLLVTMSTPRGVFTESATLTRLAASLARDCTLFLTSPNVYRGLLADFQALLRAEQASGDVDKLHPVCPAGTFKLCPIPWPHSTGFAQVQCSNLNLNYLIQLSRPPEFLNEPGRMDPVKELKSIPRLKRKKPFHWLPSIGKKREIDISSSQMVSLPSYPVAPTSRASPSPFCPELRRGQSMPSLREGWRLADELGLPPLPSRPLTPLVLATESKPELTGLIVAEDLKQLIKKMKLEGTRYPPLDSGLPPLLGVVTRHPAAGHRLEELEKMLRNLQEEEASGQWDPQPPKSFPLHPQPVTITLKLRNEVVVQAAAVRVSDRNFLDSFHIEGAGALYNHLAGELDPKAIEKMDIDNFVGSTTREVYKELMSHVSSDHLHFDQGPLVEPAADKDWSTFLSSAFLRQEKQPQIINPELVGLYSQRANTLQSNTKKMPSLPSLQATKSWEKWSNKASLMNSWKTTLSVDDYFKYLTNHETDFLHVIFQMHEEEVPVEIVAPARESLEIQHPPPLLEDEEPDFVPGEWDWNTVLEHRLGAGKTPHLGEPHKILSLQKHLEQLWSVLEVPDKDQVDMTIKYSSKARLRQLPSLVNAWERALKPIQLREALLARLEWFEGQASNPNRFFKKTNLSSSHFLEENQVRSHLHRKLNLMESSLVSLLEEIELIFGEPVIFKGRPYLDKMKSDKVEMLYWLQQQRRVRHLVSALKDPHQSTLFRSSAASL

SEQ ID NO: 11375 - protein, 531 aa, Homo sapiens
MAATLDLKSKEEKDAELDKRIEALRRKNEALIRRYQEIEEDRKKAELEGVAVTAPRKGRSVEKENVAVESEKNLGPSRRSPGTPRPPGASKGGRTPPQQGGRAGMGRASRSWEGSPGEQPRGGGAGGRGRRGRGRGSPHLSGAGDTSISDRKSKEWEERRRQNIEKMNEEMEKIAEYERNQREGVLEPNPVRNFLDDPRRRSGPLEESERDRREESRRHGRNWGGPDFERVRCGLEHERQGRRAGLGSAGDMTLSMTGRERSEYLRWKQEREKIDQERLQRHRKPTGQWRREWDAEKTDGMFKDGPVPAHEPSHRYDDQAWARPPKPPTFGEFLSQHKAEASSRRRRKSSRPQAKAAPRAYSDHDDRWETKEGAASPAPETPQPTSPETSPKETPMQPPEIPAPAHRPPEDEGEENEGEEDEEWEDISEDEEEEEIEVEEGDEEEPAQDHQAPEAAPTGIPCSEQAHGVPFSPEEPLLEPQAPGTPSSPFSPPSGHQPVSDWGEEVELNSPRTTHLAGALSPGEAWPFESV

SEQ ID NO: 11376 - protein, 513 aa, Homo sapiens
MAATLDLKSKEEKDAELDKRIEALRRKNEALIRRYQEIEEDRKKAELEGVAVTAPRKGRSVEKENVAVESEKNLGPSRRSPGTPRPPGASKGGRTPPQQGGRAGMGRASRSWEGSPGEQPRGGGAGDTSISDRKSKEWEERRRQNIEKMNEEMEKIAEYERNQREGVLEPNPVRNFLDDPRRRSGPLEESERDRREESRRHGRNWGGPDFERVRCGLEHERQGRRAGLGSAGDMTLSMTGRERSEYLRWKQEREKIDQERLQRHRKPTGQWRREWDAEKTDGMFKDGPVPAHEPSHRYDDQAWARPPKPPTFGEFLSQHKAEASSRRRRKSSRPQAKAAPRAYSDHDDRWETKEGAASPAPETPQPTSPETSPKETPMQPPEIPAPAHRPPEDEGEENEGEEDEEWEDISEDEEEEEIEVEEGDEEEPAQDHQAPEAAPTGIPCSEQAHGVPFSPEEPLLEPQAPGTPSSPFSPPSGHQPVSDWGEEVELNSPRTTHLAGALSPGEAWPFESV

SEQ ID NO: 11377 - protein, 331 aa, Homo sapiens
MTSPHFSSYDEGPLDVSMAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENTIKEREKKYLEELKAKSHKLTLLSSELEQRASTIAYLTSQLHAAKKKLMSSSGTSDASPSGSPVLASYKPAPPKDKLPETPRRRMKKSLSAPLHPEFEEVYRFGAESRKLLLREPVDAMPDPTPFLLARESAEVHLIKERPLVIPPIASDRSGEQHSPAREKPHKAHVGVAHRIHHATPPQAQPEVKTLAVDQVNGGKVVRKHSGTDRTV

SEQ ID NO: 11378 - protein, 96 aa, Homo sapiens
MTSPHFSSYDEGPLDVSMAATNLENQLHSAQKNLLFLQREHASTLKGLHSEIRRLQQHCTDLTYELTVKSSEQTGDGTSKSSELKKRCEELEAQLK

SEQ ID NO: 11379 - protein, 122 aa, Homo sapiens
MTSPHFSSYDEGPLDVSMAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENT

SEQ ID NO: 11380 - protein, 12 aa, Homo sapiens
MTSPHFSSYDEG

SEQ ID NO: 11381 - protein, 631 aa, Homo sapiens
MGLPRGPEGQGLPEVETREDEEQNVKLTEILELLVAAGYFRARIKGLSPFDKVVGGMTWCITTCNFDVDVDLLFQENSTIGQKIALSEKIVSVLPRMKCPHQLEPHQIQGMDFIHIFPVVQWLVKRAIETKEEMGDYIRSYSVSQFQKTYSLPEDDDFIKRKEKAIKTVVDLSEVYKPRRKYKRHQGAEELLDEESRIHATLLEYGRRYGFSRQSKMEKAEDKKTALPAGLSATEKADAHEEDELRAAEEQRIQSLMTKMTAMANEESRLTASSVGQIVGLCSAEIKQIVSEYAEKQSELSAEESPEKLGTSQLHRRKVISLNKQIAQKTKHLEELRASHTSLQARYNEAKKTLTELKTYSEKLDKEQAALEKIESKADPSILQNLRALVAMNENLKSQEQEFKAHCREEMTRLQQEIENLKAERAPRGDEKTLSSGEPPGTLTSAMTHDEDLDRRYNMEKEKLYKIRLLQARRNREIAILHRKIDEVPSRAELIQYQKRFIELYRQISAVHKETKQFFTLYNTLDDKKVYLEKEISLLNSIHENFSQAMASPAARDQFLRQMEQIVEGIKQSRMKMEKKKQENKMRRDQLNDQYLELLEKQRLYFKTVKEFKEEGRKNEMLLSKVKAKAS

SEQ ID NO: 11382 - protein, 323 aa, Homo sapiens
MSERKVLNKYYPPDFDPSKIPKLKLPKDRQYVVRLMAPFNMRCKTCGEYIYKGKKFNARKETVQNEVYLGLPIFRFYIKCTRCLAEITFKTDPENTDYTMEHGATRNFQAEKLLEEEEKRVQKEREDEELNNPMKVLENRTKDSKLEMEVLENLQELKDLNQRQAHVDFEAMLRQHRLSEEERRRQQQEEDEQETAALLEEARKRRLLEDSDSEDEAAPSPLQPALRPNPTAILDEAPKPKRKVEVWEQSVGSLGSRPPLSRLVVVKKAKADPDCSNGQPQAAPTPGAPQNRKEANPTPLTPGASSLSQLGAYLDSDDSNGSN

SEQ ID NO: 11383 - protein, 555 aa, Homo sapiens
MDVSSEHTKDPGGEGGDGESLAARPSKIKASSGPPTSPEPGELESEPEEEEEEQAASQGGTAADEQAEAPKGLTAAEAAGEEGPGEPGRPAEPQPEPEEPAEVGAEEPAQPEPGAGPEELEAEAGAEELEQAAEGKEVRFQASLPLTRIDEEEAAAAPEAETERVEGEEEDKEETQRDGAESKERDGEGRPAKSQEEGKRLYGRDEFEDLEWSEEVQKLQEQQLRSDLLDQYRSLLVERNRSQRYNLYLQHKIFEALRRKKGLEAAEVADRGAEAEAPEKEQAYLRHLGMLEELKKQQADDLQWYHQELGQLKRQCQEKLTRVEKEWRRFQALKKQVVMQAMGSCRMRGGRQAALREVEQIQALEDKKEKEMSAVRLENIQLKQSLVHFETRMRTQEDLTQGLLLIDFEQLKIENQTFNEKIEERNEELLKLRSKVTNSVQVITHVKEKLHFMDMENACKKTQLAEIEAQAALGRDILTKTKQAREGLRTDNIRLNQKCGLLGKDSLLRDLEEKVDKTELLHRRLESLKRHHASLTLSCRGVRQKIREAKAFLPS

SEQ ID NO: 11384 - protein, 343 aa, Homo sapiens
MEAVATATAAKEPDKGCIEPGPGHWGELSRTPVPSKPQDKVEAAEATPVALDSDTSGAENAAVSAMLHAVAASRLPVCSQQQGEPDLTEHEKVAILAQLYHEKPLVFLERFRTGLREEHLACFGHVRGDHRADFYCAEVARQGTARPRTLRTRLRNRRYAALRELIQGGEYFSDEQMRFRAPLLYEQYIGQYLTQEELSARTPTHQPPKPGSPGRPACPLSNLLLQSYEERELQQRLLQQQEEEEACLEEEEEEEDSDEEDQRSGKDSEAWVPDSEERLILREEFTSRMHQRFLDGKDGDFDYSTVDDNPDFDNLDIVARDEEERYFDEEEPEDAPSPELDGD

SEQ ID NO: 11385 - protein, 153 aa, Homo sapiens
MEPLYQAGSILMTVNTLQGKKMIESGLQSGDFSLSQSWPSCLPPPADLEILQQKVAGVQRELEDFKKEALKSIHYLEDAFCEMNGALVQQEEQAARVRQRLREEEDRGIVRNKVLTFLLPREKQLREHCKRLEDLLLDRGRDALRATKKSQAD

SEQ ID NO: 11386 - protein, 110 aa, Homo sapiens
MQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAQPLPAS

SEQ ID NO: 11387 - protein, 235 aa, Homo sapiens
MGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKPRRVEPVCSGLQAQILHCYRDRPHEVLLCSDLVKAYQRCVSAAHKG

SEQ ID NO: 11388 - protein, 166 aa, Homo sapiens
  MOD_RES (1)..(1): Any amino acid
XTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKVEPVCSGLQAQILHCYRDRPHEVLLCSDLVKAYQRCVSAAHKG

SEQ ID NO: 11389 - protein, 199 aa, Homo sapiens
MLLELSEEHKEHLAFLPQVDSAVVAEFGRIAVEFLRRGANPKIYEGAARKLNVSSDTVQHGVEGLTYLLTESSKLMISELDFQDSVFVLGFSEELNKLLLQLYLDNRKEIRTILSELAPSLPSYHNLEWRLDVQLASRSLRQQIKPAVTIKLHLNQNGDHNTKVLQTDPATLLHLVQQLEQALEEMKTNHCRRVVRNIK

SEQ ID NO: 11390 - protein, 177 aa, Homo sapiens
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGRTLIPHPIQRLVLVAAWNNYRTWWGNLKMLRKAWKEQLSCNLGKLTIRPSAEENQKRLAFS

SEQ ID NO: 11391 - protein, 162 aa, Homo sapiens
MELSESVQKGFQMLADPRSFDSNAFTLLLRAAFQSLLDAQADEAVLDHPDLKHIDPVVLKHCHAAAATYILEAGKHRADKSTLSIGRSLPHITDVSWRLEYQIKTNQLHRMYRPAYLVTLSVQNTDSPSYPEISFSCSMEQLQDLVGKLKDASKSLERATQL

SEQ ID NO: 11392 - protein, 195 aa, Homo sapiens
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 11393 - protein, 177 aa, Homo sapiens
  MOD_RES (1)..(1): Any amino acid
XELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGRTLIPHPIQRLVLVAAWNNYRTWWGNLKMLRKAWKEQLSCNLGKLTIRPSAEENQKRLAFS

SEQ ID NO: 11394 - protein, 149 aa, Homo sapiens
  MOD_RES (1)..(1): Any amino acid
XLPDAGGSPLLRLQRLHASPPGGIPESAGRPGGRGRVSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 11395 - protein, 163 aa, Homo sapiens
  MOD_RES (1)..(1): Any amino acid
XMELSESVQKGFQMLADPRSFDSNAFTLLLRAAFQSLLDAQADEAVLDHPDLKHIDPVVLKHCHAAAATYILEAGKHRADKSTLSIGRSLPHITDVSWRLEYQIKTNQLHRMYRPAYLVTLSVQNTDSPSYPEISFSCSMEQLQDLVGKLKDASKSLERATQL

SEQ ID NO: 11396 - protein, 200 aa, Homo sapiens
MGRLHCTEDPVPEAVGGDMQQLNQLGAQQFSALTEVLFHFLTEPKEVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIELTLPQFYSFLHEMERVRTSMECFC

SEQ ID NO: 11397 - protein, 199 aa, Homo sapiens
MGRLHCTEDPVPEAVGGDMQQLNQLGAQFSALTEVLFHFLTEPKEVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIELTLPQFYSFLHEMERVRTSMECFC

SEQ ID NO: 11398 - protein, 183 aa, Homo sapiens
MEPEEGTPLWRLQKLPAELGPQLLHKIIDGICGRAYPVYQDYHTVWESEEWMHVLEDIAKFFKAIVGKNLPDEEIFQQLNQLNSLHQETIMKCVKSRKDEIKQALSREIVAISSAQLQDFDWQVKLALSSDKIAALRMPLLSLHLDVKENGEVKPYSIEMSREELQNLIQSLEAANKVVLQLK

SEQ ID NO: 11399 - protein, 198 aa, Homo sapiens
MAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 11400 - protein, 169 aa, Homo sapiens
MAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAV

SEQ ID NO: 11401 - protein, 156 aa, Homo sapiens
MAALTAEHFAALQSLLKLLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 11402 - protein, 688 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 11403 - protein, 688 aa, Homo sapiens; identical to SEQ ID NO: 11402

SEQ ID NO: 11404 - protein, 160 aa, Homo sapiens
MAFLMKSMISNQVKNLGFGGGSEENKEEGGASDPAAAQGMTREEYEEYQKQMIEEKMERDAAFTQKKAERACLRVHLREKYRLPKSEMDENQIQMAGDDVDLPEDLRKMVDEDQEEEEDKDSILGQIQNLQNMDLDTIKEKAQATFTEIKQTAEQKCSVM

SEQ ID NO: 11405 - protein, 1307 aa, Homo sapiens
MGSVTGAVLKTLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGDLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 11406 - protein, 1259 aa, Homo sapiens
MGSVTGAVLKTLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGDLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 11407 - protein, 1235 aa, Homo sapiens
MWNYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 11408 - protein, 503 aa, Homo sapiens
MSLGGASERSVPATKIEITVSCRNLLDLDTFSKSDPMVVLYTQSRASQEWREFGRTEVIDNTLNPDFVRKFVLDYFFEEKQNLRFDVYNVDSKTNISKPKDFLGQAFLALGEVIGGQGSRVERTLTGVPGKKCGTILLTAEELSNCRDIATMQLCANKLDKKDFFGKSDPFLVFYRSNEDGTFTICHKTEVVKNTLNPVWQPFSIPVRALCNGDYDRTVKIDVYDWDRDGSHDFIGEFTTSYRELSKAQNQFTVYEVLNPRKKCKKKKYVNSGTVTLLSFSVDSEFTFVDYIKGGTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVINQVARAAAKISDGSQYYVLLIITDGVISDMTQTKEAIVSASSLPMSIIIVGVGPAMFEAMEELDGDDVRVSSRGRYAERDIVQEGCCSLGTSVV

SEQ ID NO: 11409 - protein, 553 aa, Homo sapiens
MSLGGASERSVPATKIEITVSCRNLLDLDTFSKSDPMVVLYTQSRASQEWREFGRTEVIDNTLNPDFVRKFVLDYFFEEKQNLRFDVYNVDSKTNISKPKDFLGQAFLALGEVIGGQGSRVERTLTGVPGKKCGTILLTAEELSNCRDIATMQLCANKLDKKDFFGKSDPFLVFYRSNEDGTFTICHKTEVVKNTLNPVWQPFSIPVRALCNGDYDRTVKIDVYDWDRDGSHDFIGEFTTSYRELSKAQNQFTVYEVLNPRKKCKKKKYVNSGTVTLLSFSVDSEFTFVDYIKGGTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVINQVARAAAKISDGSQYYVLLIITDGVISDMTQTKEAIVSASSLPMSIIIVGVGPAMFEAMEELDGDDVRVSSRGRYAERDIVQFVPFRDYVDRSGNQVLSMARLAKDVLAEIPEQLLSYMRTRDIQPRPPPPANPSPIPAPEQP

SEQ ID NO: 11410 - protein, 537 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPAQAPQA

SEQ ID NO: 11411 - protein, 542 aa, Homo sapiens
MKMMHMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPAQAPQA

SEQ ID NO: 11412 - protein, 537 aa, Homo sapiens; identical to SEQ ID NO: 11410

SEQ ID NO: 11413 - protein, 537 aa, Homo sapiens; identical to SEQ ID NO: 11410

SEQ ID NO: 11414 - protein, 537 aa, Homo sapiens; identical to SEQ ID NO: 11410

SEQ ID NO: 11415 - protein, 537 aa, Homo sapiens; identical to SEQ ID NO: 11410

SEQ ID NO: 11416 - protein, 304 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDS

SEQ ID NO: 11417 - protein, 136 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKD

SEQ ID NO: 11418 - protein, 209 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQ

SEQ ID NO: 11419 - protein, 202 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGG

SEQ ID NO: 11420 - protein, 67 aa, Homo sapiens
MAHCVTLVQLSISCDHLIDKDIGSKSDPLCVLLQDVGGGSWAELGRTERVRNCSSPEFSKTLQLEYR

SEQ ID NO: 11421 - protein, 152 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKK

SEQ ID NO: 11422 - protein, 231 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSL

SEQ ID NO: 11423 - protein, 174 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHL

SEQ ID NO: 11424 - protein, 548 aa, Homo sapiens
MAHIPSGGAPAAGAAPMGPQYCVCKVELSVSGQNLLDRDVTSKSDPFCVLFTENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAVLAELPQQVVQYFKHKNLPPTNSEPA

SEQ ID NO: 11425 - protein, 548 aa, Homo sapiens; identical to SEQ ID NO: 11424

SEQ ID NO: 11426 - protein, 446 aa, Homo sapiens
MRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAVLAELPQQVVQYFKHKNLPPTNSEPA

SEQ ID NO: 11427 - protein, 557 aa, Homo sapiens
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 11428 - protein, 575 aa, Homo sapiens
MAVEPSSSESIKRRAGRRMKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 11429 - protein, 169 aa, Homo sapiens
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDK

SEQ ID NO: 11430 - protein, 557 aa, Homo sapiens; identical to SEQ ID NO: 11427

SEQ ID NO: 11431 - protein, 575 aa, Homo sapiens; identical to SEQ ID NO: 11428

SEQ ID NO: 11432 - protein, 564 aa, Homo sapiens
MDSRYNSTAGIGDLNQLSAAIPATRVEVSVSCRNLLDRDTFSKSDPICVLYVQGVGNKEWREFGRTEVIDNTLNPDFVRKFILDYFFEERENLRFDLYDVDSKSPNLSKHDFLGQVFCTLGEIVGSQGSRLEKPIVGIPGKKCGTIILTAEELNCCRDAVLMQFCANKLDKKDFFGKSDPFLVFYRSNEDGSFTICHKTEVVKNTLNPVWQAFKISVRALCNGDYDRTIKVEVYDWDRDGSHDFIGEFTTSYRELSRGQSQFNVYEVVNPKKKGKKKKYTNSGTVTLLSFLVETEVSFLDYIKGGTQINFTVAIDFTASNGNPAQPTSLHYMNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPTHVLQTQI

SEQ ID NO: 11433 - protein, 1261 aa, Homo sapiens
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 11434 - protein, 469 aa, Homo sapiens
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYGAAEAVIRLLSLLLNTTAPGTAKPRTLWMSEGRSSLHNPEIKCSCFSSSSPFPQSLLSLLLGLSSICECMCTLRHTHAHTHNPSCVLPTSEILAFGRQSLIS

SEQ ID NO: 11435 - protein, 1343 aa, Homo sapiens
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 11436 - protein, 1146 aa, Homo sapiens
LRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 11437 - protein, 379 aa, Homo sapiens
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYCCASFPTQAKRF

SEQ ID NO: 11438 - protein, 274 aa, Homo sapiens
MEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSESSGGATLWKNTWADPQRALPGDPPPPLCPRRRRIQRADSKQTPSQYRPSRSLPTMRAGTP

SEQ ID NO: 11439 - protein, 840 aa, Homo sapiens
MNRFRVSKFRHTEARPPRRESWISDIRAGTAPSCRNHIKSSCSLIAFNSDRPGVLGIVPLQGQGEDKRRVAHLGCHSELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 11440 - protein, 81 aa, Homo sapiens
MSSTYCGNSSAKMSVNEVSAFSLTLEQKTGFAFVGILCIFLGLLIIRCFKILLDPYSSMPSSTWEDEVEEFDKGTFEYALA

SEQ ID NO: 11441 - protein, 81 aa, Homo sapiens; identical to SEQ ID NO: 11440

SEQ ID NO: 11442 - protein, 301 aa, Homo sapiens
MSYPTKEGSDTAGNAHKNSENEPPNDCSTDIESPSADPNMIYQVETNPINREPGTATSQEDVVPQAAENSELETEIQKDQREEDLKEELLLLQTPIPRKLVSHKPLNDRSRSHSGKVEMKANNFPINHKTRFRLSTSWRVPFINSHEIRSMILHLLCDRYFSQAAGCQNTMWVKRKYIACLYHPNSFTHHERAITFRRPSRVHYYRPLTERMTSGKFCKSTDTKGKCRFRAIVRSVLFVSQIQIESIFNIKGFVDILTYIHTMNVMITNTNNGWKYFCPICGRLFNTYSELRQHSCSSSGN

SEQ ID NO: 11443 - protein, 301 aa, Homo sapiens; identical to SEQ ID NO: 11442

SEQ ID NO: 11444 - protein, 644 aa, Homo sapiens
MLRTDAGEDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISMQSDFFLPKPRKLRNRHLRKPLVVQRTLLPRPSENQSHNVCSFSILSNSSVTGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 11445 - protein, 1269 aa, Homo sapiens
MTVKLGDGGSGEDGLKKLGKRAADEESLEGEGAGGADAAEESSGTKRDEKTPRAGADGPPAPPGAPQAPSPPQGSPQDQHHFLRSSVRPQSKRPRKDPPSAVGSGNAGGSGPRGKGAEGGGSSSGNVSGVAPAAPAGGSRSSSRNLGSSGGEKEEGKKVRRQWESWSTEDKNTFFEGLYEHGKDFEAIQNNIALKYKKKGKPASMVKNKEQVRHFYYRTWHKITKYIDFDHVFSRGLKKSSQELYGLICYGELRKKIGGCMDDKNATKLNELIQVGATTVRYKGRNLRIKAPMCRALKKLCDPDGLSDEEDQKPVRLPLKVPIELQPRNNHAWARVQSLAQNPRLRMIVELHRKVSSLIEFLKQKWALHEVRVRKTLEERQLQDSCSAPMQEKVTLHLFPGENCTLTPLPGVARVVHSKAFCTVHWQEGGRCKQSAKDAHVLPPAQILGIQSGQGTARGQVKCPRSGAEGKGVGRPPPAADALQSSGESSPESAPGEGAALSLSSPDAPDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISMQSDFFLPKPRKLRNRHLRKPLVVQRTLLPRPSENQSHNVCSFSILSNSSVTGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 11446 - protein, 1269 aa, Homo sapiens; identical to SEQ ID NO: 11445

SEQ ID NO: 11447 - protein, 1266 aa, Homo sapiens
MTVKLGDGGSGEDGLKKLGKRAADEESLEGEGAGGADAAEESSGTKRDEKTPRAGADGPPAPPGAPQAPSPPQGSPQDQHHFLRSSVRPQSKRPRKDPPSAVGSGNAGGSGPRGKDRHLPKAQLWLSISRVPFGGSRSSSRNLGSSGGEKEEGKKVRRQWESWSTEDKNTFFEGLYEHGKDFEAIQNNIALKYKKKGKPASMVKNKEQVRHFYYRTWHKITKYIDFDHVFSRGLKKSSQELYGLICYGELRKKIGGCMDDKNATKLNELIQVGATTVRYKGRNLRIKAPMCRALKKLCDPDGLSDEEDQKPVRLPLKVPIELQPRNNHAWARVQSLAQNPRLRMIVELHRKVSSLIEFLKQKWALHEVRVRKTLEERQLQDSCSAPMQEKVTLHLFPGENCTLTPLPGVARVVHSKAFCTVHWQEGGRCKQSAKDAHVLPPAQILGIQSGQGTARGQVKCPRSGAEGKGVGRPPPAADALQSSGESSPESAPGEGAALSLSSPDAPDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISMQSDFFLPKPRKLRNRHLRKPLVVQRTLLPRPSENQSHNVCSFSILSNSSVTGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 11448 - protein, 175 aa, Homo sapiens
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 11449 - protein, 175 aa, Homo sapiens; identical to SEQ ID NO: 11448

SEQ ID NO: 11450 - protein, 175 aa, Homo sapiens; identical to SEQ ID NO: 11448

SEQ ID NO: 11451 - protein, 182 aa, Homo sapiens
MAQRSGKITLYEGKHFTGQKLEVFGDCDNFQDRGFMNRVNSIHVESGAWVCFNHPDFRGQQFILEHGDYPDFFRWNSHSDHMGSCRPVGMHGEHFRLEIFEGCNFTGQCLEFLEDSPFLQSRGWVKNCVNTIKVYGDGAAWSPRSFGAEDFQLSSSLQSDQGPEEATTKPATTQPPFLTANL

SEQ ID NO: 11452 - protein, 148 aa, Homo sapiens
MGRAGPRSTADTRPRATVITTRRPRPWQKPTSPRRLHRRRPRGQPASENAAEPSQVAISKGKSPDYANGGKAAMDSRASDAINKSKVDTSASNPSQRRPSRLRGKRSLALPPRLECLFPSSCGSRRATSRPGFPPLEGSHLGCQLLPL

SEQ ID NO: 11453 - protein, 804 aa, Homo sapiens
MEEPGVTPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 11454 - protein, 771 aa, Homo sapiens
MEEPGVTPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFASARSPPGAGAPASGRGLGGPQK

SEQ ID NO: 11455 - protein, 792 aa, Homo sapiens
MELKSPEEEVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 11456 - protein, 761 aa, Homo sapiens
MEEPGVTPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 11457 - protein, 672 aa, Homo sapiens
MELKSPEEEVVAALPEGMRPDSNLYGFPWELVICAAVVGFFAVLFFLWRSFRSVRSRLYVGREKKLALMLSGLIEEKSKLLEKFSLVQKEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPPGPPPAPFAMRNVYPPRGFPPYLPPRPGFFPPPPHSEGRSEFPSGLIPPSNEPATEHPEPQQET

SEQ ID NO: 11458 - protein, 809 aa, Homo sapiens
MEEPGVTPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEVENQMATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 11459 - protein, 775 aa, Homo sapiens
MRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 11460 - protein, 466 aa, Homo sapiens
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTNQHVKQNGKLEDNPSSGSPPRTTLLGTIFSPVFNFFSPANKNGTSGSDSPGQAVEAEEIVKQLDMEQVDEITTSTTTSTNGAAYSNQAVQVRPSLNNGLEEAEETVNRDIPPLTAPVTPDSGYSSAHAEATYEEDWEVFDPYYFIKHVPPLTEEQLNRKPALPLKTRSTPEFSLVLDLDETLVHCSLNELEDAALTFPVLFQDVIYQVYVRLRPFFREFLERMSQMYEIILFTASKKVYADKLLNILDPKKQLVRHRLFREHCVCVQGNYIKDLNILGRDLSKTIIIDNSPQAFAYQLSNGIPIESWFMDKNDNELLKLIPFLEKLVELNEDVRPHIRDRFRLHDLLPPD

SEQ ID NO: 11461 - protein, 394 aa, Homo sapiens
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTNQHVKQNGKLEDNPSSGSPPRTTLLGTIFSPVFNFFSPANKNAPVTPDSGYSSAHAEATYEEDWEVFDPYYFIKHVPPLTEEQLNRKPALPLKTRSTPEFSLVLDLDETLVHCSLNELEDAALTFPVLFQDVIYQVYVRLRPFFREFLERMSQMYEIILFTASKKVYADKLLNILDPKKQLVRHRLFREHCVCVQGNYIKDLNILGRDLSKTIIIDNSPQAFAYQLSNGIPIESWFMDKNDNELLKLIPFLEKLVELNEDVRPHIRDRFRLHDLLPPD

SEQ ID NO: 11462 - protein, 394 aa, Homo sapiens; identical to SEQ ID NO: 11461

SEQ ID NO: 11463 - protein, 165 aa, Homo sapiens
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTNQHVKQNGKLEDNPSSGSPPRTTLLGTIFSPVFNFFSPANKNGTSGSDS

SEQ ID NO: 11464 - protein, 466 aa, Homo sapiens; identical to SEQ ID NO: 11460

SEQ ID NO: 11465 - protein, 92 aa, Homo sapiens
MRLRTRKASQQSNQIQTQRTARAKRKYSEVDDSLPSGGEKPSKNETGLLSSIKKFIKGSTPKEERENPSKRSRIERDIDNNLITSTPRAGEK

SEQ ID NO: 11466 - protein, 117 aa, Homo sapiens
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTN

SEQ ID NO: 11467 - protein, 173 aa, Homo sapiens
MGDLPWAPPEAQAPSTAGAGDVAEHQVAPARFLQGAWRQAAGWLCRETGAAPGSAQAGPPETAHAADPQPRGPQAPPRLPPSLSPERVHPGQPAAPAEPAPGAPALRSGPSQPRGLRLPVPVPACAGSSAPGSPAALPDSYPWPPPARNRPATLPPTSRVSPLAAFLASAPQR

SEQ ID NO: 11468 - protein, 83 aa, Homo sapiens
MASTPMGNEGEKKSSWPSQAAPSLRGGPASLSRSEEYLSQISAELMEEALCTACCHLNPVPIKKKQSQDQATQISKRAFFTKT

SEQ ID NO: 11469 - protein, 201 aa, Homo sapiens
MFLVVAVNSLTLYQPSFRPLLGDACCLCVAAAAGALCRDLGPHHTHTRGPNDGSCGLSRWRHRQHGDSPEDFFLARGAHLASTRGRNEHSPKGSLQKCLLSIRVQTTRLSHLRAGVTLRCVLLCVSESPVGLRSVACSGDLLGDPLTGFLAFLVSCLTPSGTPGNTSLTKLSPTSSSQGLALGPLSPSSCDAASPSISLGL

SEQ ID NO: 11470 - protein, 214 aa, Homo sapiens
MEPAREPPSRARPPPPLAARPAPAPAAPRPRSPAEAEARGPEGLLRRSGSGYEGSTSWKAALEDTTTRLLLGAIAVLLFAILVVMSILASKGCIKCEAPCPEDWLLYGRKCYFFSEEPRDWNTGRQYCHTHEAVLAVIQSQKELEFMFKFTRREPWIGLRRVGDEFHWVNGDPFDPDTFTIAGPGECVFVEPTRLVSTECLMTRPWVCSKMAYT

SEQ ID NO: 11471 - protein, 607 aa, Homo sapiens
MELVRRLMPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 11472 - protein, 607 aa, Homo sapiens; identical to SEQ ID NO: 11471

SEQ ID NO: 11473 - protein, 386 aa, Homo sapiens
MTSLFRRSSSGSGGGGTAGARGGGGGTAAPQELNNSRPARQVRRLEFNQAMDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDERIALFLQNEEFMKELQRNRDFLLALERDRLKYESQKSKSSSVAVGNDFGFSSPVPGTGDANPAVSEDALFRDKLKHMGKSTRRKLFELARAFSEKTKMRKSKRKHLLKHQSLGAAASTANLLDDVEGHACDEDFRGRRQEAPKVEEGLREGQ

SEQ ID NO: 11474 - protein, 386 aa, Homo sapiens; identical to SEQ ID NO: 11473

SEQ ID NO: 11475 - protein, 156 aa, Homo sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 11476 - protein, 198 aa, Homo sapiens
MIGSGLAGSGGAGGPSSTVTWCALFSNHVAATQASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 11477 - protein, 156 aa, Homo sapiens; identical to SEQ ID NO: 11475

SEQ ID NO: 11478 - protein, 179 aa, Homo sapiens
MSGGRAPAVLLGGVASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 11479 - protein, 179 aa, Homo sapiens; identical to SEQ ID NO: 11478

SEQ ID NO: 11480 - protein, 42 aa, Homo sapiens
MSGGRAPAVLLGGVVSDRPRPAPSGPRSLDRYPHPKSQRLAP

SEQ ID NO: 11481 - protein, 229 aa, Homo sapiens
MTTAARPTFEPARGGRGKGEGDLSQLSKQYSSRDLPSHTKIKYRQTTQDAPEEVRNRDFRRELEERERAAAREKNRDRPTREHTTSSSVSKKPRLDQIPAANLDADDPLTDEEDEDFEEESDDDDTAALLAELEKIKKERAEEQARKEQEQKAEEERIRMENILSGNPLLNLTGPSQPQANFKVKRRWDDDVVFKNCAKGVDDQKKDKRFVNDTLRSEFHKKFMEKYIK

SEQ ID NO: 11482 - protein, 425 aa, Homo sapiens
MGGGDLNLKKSWHPQTLRNVEKVWKAEQKHEAERKKIEELQRELREERAREEMQRYAEDVGAVKKKEEKLDWMYQGPGGMVNRDEYLLGRPIDKYVFEKMEEKEAGCSSETGLLPGSIFAPSGANSLLDMASKIREDPLFIIRKKEEEKKREVLNNPVKMKKIKELLQMSLEKKEKKKKKEKKKKHKKHKHRSSSSDRSSSEDEHSAGRSQKKMANSSPVLSKVPGYGLQVRNSDRNQGLQGPLTAEQKRGHGMKNHSRSRSSSHSPPRHASKKSTREAGSRDRRSRSLGRRSRSPRPSKLHNSKVNRRETGQTRSPSPKKEVYQRRHAPGYTRKLSAEELERKRQEMMENAKWREEERLNILKRHAKDEEREQRLEKLDSRDGKFIHRMKLESASTSSLEDRVKRNIYSLQRTSVALEKNFMKR

SEQ ID NO: 11483 - protein, 362 aa, Homo sapiens [sequence omitted]

SEQ ID NO: 11484 - protein, 538 aa, Homo sapiens
MAQKPLRLLACGDVEGKFDILFNRVQAIQKKSGNFDLLLCVGNFFGSTQDAEWEEYKTGIKKAPIQTYVLGANNQETVKYFQDADGCELAENITYLGRKGIFTGSSGLQIVYLSGTESLNEPVPGYSFSPKDVSSLRMMLCTTSQFKGVDILLTSPWPKCVGNFGNSSGEVDTKKCGSALVSSLATGLKPRYHFAALEKTYYERLPYRNHIILQENAQHATRFIALANVGNPEKKKYLYAFSIVPMKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQVIPVPISCSTTDDIKDAFITQAQEQQIELLEIPEHSDIKQIAQPGAAYFYVELDTGEKLFHRIKKNFPLQFGREVLASEAILNVPDKSDWRQCQISKEDEETLARRFRKDFEPYDFTLDD

SEQ ID NO: 11485 - protein, 253 aa, Homo sapiens
MKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQIAQPGAAYFYVELDTGEKLFHRIKKNFPLQFGREVLASEAILNVPDKSDWRQCQISKEDEETLARRFRKDFEPYDFTLDD

SEQ ID NO: 11486 - protein, 538 aa, Homo sapiens; identical to SEQ ID NO: 11484

SEQ ID NO: 11487 - protein, 894 aa, Homo sapiens
MATSMAAASGRFESAKSIEERKEQTRNARAEVLRQAKANFEKEERRKELKRLRGEDTWMLPDVNERIEQFSQEHSVKKKKKKDKHSKKAKKEKKKKSKKQKYEKNNESSDSSSSSEDEWVEAVPSQTPDKEKAWKVKDEKSGKDDTQIIKRDEWMTVDFMSVKTVSSSSLKAEKETMRKIEQEKNQALEQSKLMERELNPYWKDGGTGLPPEDCSVSSITKVSVVEDGGLSWLRKSYLRMKEQAEKQSRNFEDIVAERYGSMEIFQSKLEDAEKAASTKEDYRRERWRKPTYSDKAQNCQESRESDLVKYGNSSRDRYATTDTAKNSNNEKFIGDEKDKRPGSLETCRRESNPRQNQEFSFGNLRAKFLRPSDDEELSFHSKGRKFEPLSSSSALVAQGSLCSGFRKPTKNSEERLTSWSRSDGRGDKKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKFMGKTDGDYYTLDDMFVSKAAERERLGEEEENQRKKAIAEHRSLAAQMEKCLYCFDSSQFPKHLIVAIGVKVYLCLPNVRSLTEGHCLIVPLQHHRAATLLDEDIWEEIQMFRKSLVKMFEDKGLDCIFLETNMSMKKQYHMVYECIPLPKEVGDMAPIYFKKAIMESDEEWSMNKKLIDLSSKDIRKSVPRGLPYFSVDFGLHGGFAHVIEDQHKFPHYFGKEIIGGMLDIEPRLWRKGIRESFEDQRKKALQFAQWWKPYDFTKSKNY

SEQ ID NO: 11488 - protein, 96 aa, Homo sapiens
MFEDKGLDCIFLETNMSMKKQYHMVYECIPLPKEVGDMAPIYFKKAIMESDEEWSMNKKLIDLSSKDIRKSVPRGLPYFSVDFGLHGGFAHVIEDQ

SEQ ID NO: 11489 - protein, 742 aa, Homo sapiens
MATSMAAASGRFESAKSIEERKEQTRNARAEVLRQAKANFEKEERRKELKRLRGEDTWMLPDVNERIEQFSQEHSVKKKKKKDKHSKKAKKEKKKKSKKQKYEKNNESSDSSSSSEDEWVEAVPSQTPDKEKAWKVKDEKSGKDDTQIIKRDEWMTVDFMSVKTVSSSSLKAEKETMRKIEQEKNQALEQSKLMERELNPYWKDGGTGLPPEDCSVSSITKVSVVEDGGLSWLRKSYLRMKEQAEKQSRNFEDIVAERYGSMEIFQSKLEDAEKAASTKEDYRRERWRKPTYSDKAQNCQESRESDLVKYGNSSRDRYATTDTAKNSNNEKFIGDEKDKRPGSLETCRRESNPRQNQEFSFGNLRAKFLRPSDDEELSFHSKGRKFEPLSSSSALVAQGSLCSGFRKPTKNSEERLTSWSRSDGRGDKKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKFMGKTDGDYYTLDDMFVSKAAERERLGEEEENQRKKAIAEHRSLAAQMEKCLYCFDSSQFPKHLIVAIGVKVYLCLPNVRSLTEGHCLIVPLQHHRAATLLDEDIWEEIQIKSRTVIQ

SEQ ID NO: 11490 - protein, 68 aa, Homo sapiens
MPQKDPCQKQACEIQKCLQANSYMESKCQAVIQELRKCCAQYPKGRSVVCSGFEKEEEENLTRKSASK

SEQ ID NO: 11491 - protein, 436 aa, Homo sapiens
MPMSSLPAAILSHMTAINNVPPPPLHSIPNLKKSKHINYGQLNALCHIRGQHSRSMSNILSAHDTFMKQYPKVFLHQKPRLPKLFKQEEQRELNEGKEESQHQQPDDSNNIAVHVQRAHGGHILYRPKRATEKFEEFLAILKKLPIHRTPYEHKTVWKFLKTIPDLTFQLNDKHLKTLSKTVFSETWLKGSTVVANDGFYVILKGLARPQTNVYKNLIEGSDSPDSFISQSFHSFIWSEEFKNSTLAEMYLPSYDSMLSKWSTFGTLEVMPQNESETQMFSVVTEDDCEILKIPAKGYAKIKEEKIKLENMQKLKLIRMCPYYEEWPTLSIYELIALLKWKKFPPGHVIVESGNIISFVGYINSGCCNIYRSIIGFVKLRSNKVKRSQKLVYMGKLKEKESFGEISVLLQVPFTCTIITKKEVEMAIIEDKDLFVA

SEQ ID NO: 11492 - protein, 291 aa, Homo sapiens
MLLPLPPQSSKPVPKKSQSSKIVPSHHDPSEKTGENCQTKISPSSLQESPSSLQGALKKRSAFEDLTNVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 11493 - protein, 1395 aa, Homo sapiens
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLKWHKLEVTPVVASTTVVPNIMEKPLILDISTTSKTPNTEEASLFRKPLVLKEEPTIEDETLINKSLSLKKCSNHEEVSLLEKLQPLQEESDSDDAFVIEPMTFKKTHKTEEAAITKKTLSLKKKMCASQRKQSCQEESLAVQDVNMEEDSFFMESMSFKKKPKTEESIPTHKLSSLKKKCTIYGKICHFRKPPVLQTTICGAMSSIKKPTTEKETLFQELSVLQEKHTTEHEMSILKKSLALQKTNFKEDSLVKESLAFKKKPSTEEAIMMPVILKEQCMTEGKRSRLKPLVLQEITSGEKSLIMKPLSIKEKPSTEKESFSQEPSALQKKHTTQEEVSILKEPSSLLKSPTEESPFDEALAFTKKCTIEEAPPTKKPLILKRKHATQGTMSHLKKPLILQTTSGEKSLIKEPLPFKEEKVSLKKKCTTQEMMSICPELLDFQDMIGEDKNSFFMEPMSFRKNPTTEETVLTKTSLSLQEKKITQGKMSHLKKPLVLQKITSEEESFYKKLLPFKMKSTTEEKFLSQEPSALKEKHTTLQEVSLSKESLAIQEKATTEEEFSQELFSLHVKHTNKSGSLFQEALVLQEKTDAEEDSLKNLLALQEKSTMEEESLINKLLALKEELSAEAATNIQTQLSLKKKSTSHGKVFFLKKQLALNETINEEEFLNKQPLALEGYPSIAEGETLFKKLLAMQEEPSIEKEAVLKEPTIDTEAHFKEPLALQEEPSTEKEAVLKEPSVDTEAHFKETLALQEKPSIEQEALFKRHSALWEKPSTEKETIFKESLDLQEKPSIKKETLLKKPLALKMSTINEAVLFEDMIALNEKPTTGKELSFKEPLALQESPTYKEDTFLKTLLVPQVGTSPNVSSTAPESITSKSSIATMTSVGKSGTINEAFLFEDMITLNEKPTTGKELSFKEPLALQESPTCKEDTFLETFLIPQIGTSPYVFSTTPESITEKSSIATMTSVGKSRTTTESSACESASDKPVSPQAKGTPKEITPREDIDEDSSDPSFNPMYAKEIFSYMKEREEQFILTDYMNRQIEITSDMRAILVDWLVEVQVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 11494 - protein, 1395 aa, Homo sapiens; identical to SEQ ID NO: 11493

SEQ ID NO: 11495 - protein, 1395 aa, Homo sapiens; identical to SEQ ID NO: 11493

SEQ ID NO: 11496 - protein, 291 aa, Homo sapiens; identical to SEQ ID NO: 11492

SEQ ID NO: 11497 - protein, 1395 aa, Homo sapiens; identical to SEQ ID NO: 11493

SEQ ID NO: 11498 - protein, 291 aa, Homo sapiens; identical to SEQ ID NO: 11492

SEQ ID NO: 11499 - protein, 291 aa, Homo sapiens; identical to SEQ ID NO: 11492

SEQ ID NO: 11500 - protein, 404 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 11501 - protein, 374 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLCMISSHV

SEQ ID NO: 11502 - protein, 404 aa, Homo sapiens; identical to SEQ ID NO: 11500

SEQ ID NO: 11503 - protein, 296 aa, Homo sapiens
MSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 11504 - protein, 377 aa, Homo sapiens
MKFPGPLENQRLSFLLEKAITREAQMWKVNVRKMPSNQNVSPSQRDEVIQWLAKLKYQFNLYPETFALASSLLDRFLATVKAHPKYLSCIAISCFFLAAKTVEEDERIPVLKVLARDSFCGCSSSEILRMERIILDKLNWDLHTATPLDFLHIFHAIAVSTRPQLLFSLPKLSPSQHLAVLTKQLLHCMACNQLLQFRGSMLALAMVSLEMEKLIPDWLSLTIELLQKAQMDSSQLIHCRELVAHHLSTLQSSLPLNSVYVYRPLKHTLVTCDKGVFRLHPSSVPGPDFSKDNSKPEVPVRGTAAFYHHLPAASGCKQTSTKRKVEEMEVDDFYDGIKRLYNEDNVSENVGSVCGTDLSRQEGHASPCPPLQPVSVM

SEQ ID NO: 11505 - protein, 125 aa, Homo sapiens
MKFPGPLENQRLSFLLEKAITREAQMWKVNVRKMPSNQNVSPSQRDEVIQWLAKLKYQFNLYPETFALASSLLDRFLATVKAHPKYLSCIAISCFFLAAKTVEEDERIPVLKVLARDSFCGCSSS

SEQ ID NO: 11506 - protein, 80 aa, Homo sapiens
MKFPGPLENQRLSFLLEKAITREAQMWKVNVRKMPSNQNVSPSQRDEVIQWLAKLKYQFNLYPETFALASSLLDRFLATV

SEQ ID NO: 11507 - protein, 363 aa, Homo sapiens
MTPRHHCEAYSSAGEEEEEEEEEKNVSPSQRDEVIQWLAKLKYQFNLYPETFALASSLLDRFLATVKAHPKYLSCIAISCFFLAAKTVEEDERIPVLKVLARDSFCGCSSSEILRMERIILDKLNWDLHTATPLDFLHIFHAIAVSTRPQLLFSLPKLSPSQHLAVLTKQLLHCMACNQLLQFRGSMLALAMVSLEMEKLIPDWLSLTIELLQKAQMDSSQLIHCRELVAHHLSTLQSSLPLNSVYVYRPLKHTLVTCDKGVFRLHPSSVPGPDFSKDNSKPEVPVRGTAAFYHHLPAASGCKQTSTKRKVEEMEVDDFYDGIKRLYNEDNVSENVGSVCGTDLSRQEGHASPCPPLQPVSVM

SEQ ID NO: 11508 - protein, 369 aa, Homo sapiens
MASGAQLPPQPSSSEVSAVQSPGGRPGAGLEETALGVPLPPSPGEAPLPRSNRSRCPGTRQPGAASLHAASAAVPVRPRRGTAPAGKTADAVPAAAPEQAPRPAPQSRKPRNLEGDLDERRLLCHLQLAQDREARLWRGGKPQDEICDAFEEVVLWLLRLQNTFYFSQSTFNLALTIFGRLLISVKVKEKYLHCATITSLRLAAKVNEEEEFIPQVKDFTKHYGSDYSPNELLRMELAILDRLHWDLYIGTPLDFLTIFHALVVLSWPHVLELLPQRNPSLHVASLTRQLQHCMAGHQLLQFKGSTLALVIITLELERLMPGWCAPISDLLKKAQVGDMQYSCCKELVMQQLRSLQSSSCTDNFVSPAN

SEQ ID NO: 11509 - protein, 330 aa, Homo sapiens
MDGPMRPRSASLVDFQFGVVATETIEDALLHLAQQNEQAVREASGRLGRFREPQIVEFVFLLSEQWCLEKSVSYQAVEILERFMVKQAENICRQATIQPRDNKRESQNWRALKQQLVNKFTLRLVSCVQLASKLSFRNKIISNITVLNFLQALGYLHTKEELLESELDVLKSLNFRINLPTPLAYVETLLEVLGYNGCLVPAMRLHATCLTLLDLVYLLHEPIYESLLRASIENSTPSQLQGEKFTSVKEDFMLLAVGIIAASAFIQNHECWSQVVGHLQSITGIALASIAEFSYAILTHGVGANTPGRQQSIPPHLAARALKTVASSNT

SEQ ID NO: 11510 - protein, 330 aa, Homo sapiens; identical to SEQ ID NO: 11509

SEQ ID NO: 11511 - protein, 307 aa, Homo sapiens
MLVRGRDQGSGSRLGPIVRRWAPRPSPLQSLAASLDAEPSSAAVPDGFPAGPTVSPRRLARPPGLEEALSALGLQGEREYAGDIFAEVMVCRVLPLRALPRAVTPEMRALVVDWLVQVHEYLGLAGDTLYLAVHLLDSYLSAGRVRLHRLQLLGVACLFVACKMEECVLPEPAFLCLLSADSFSRAELLRAERRILSRLDFRLHHPGPLLCLGLLAALAGSSPQVMLLATYFLELSLLEAEAAGWEPGRRAAAALSLAHRLLDGAGSRLQPELYRCSLGGGSVWGHRSFRDLPSWSFLRSRRMRDNY

SEQ ID NO: 11512 - protein, 155 aa, Homo sapiens
MLVRGRDQGSGSRLGPIVRRWAPRPSPLQSLAASLDAEPSSAAVPDGFPAGPTVSPRRLARPPGLEEALSALGLQGEREYAGDIFAEVMEYLGLAGDTLYLAVHLLDSYLSAGRVRLHRLQLLGVACLFVACKMEECVLPEETEVRNLGPFQGRE

SEQ ID NO: 11513 - protein, 359 aa, Homo sapiens
MGNTLTCCVSPNASPKLGRRAGSAELYCASDIYEAVSGDAVAVAPAVVEPAELDFGEGEGHHLQHISDREMPEDLALESNPSDHPRASTIFLSKSQTDVREKRKSNHLNHVSPGQLTKKYSSCSTIFLDDSTVSQPNLRTTVKCVTLAIYYHIKNRDANRSLDIFDERSHPLTREKVPEEYFKHDPEHKFIYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLEAISRLCEDKDLCRAAMRRSFSADNFIGIQRSKAILS

SEQ ID NO: 11514 - protein, 308 aa, Homo sapiens
MGNTLTCCVSPNASPKLGRRAGSAELYCASDIYEAVSGDAVAVAPAVVEPAELDFGEGEGHHLQHISDREMPEDLALESNPSDHPRASTIFLSKSQTDVREKRKSNHLNHCDLSNILPHKEQREKVPEEYFKHDPEHKFIYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLEAISRLCEDKDLCRAAMRRSFSADNFIGIQRSKAILS

SEQ ID NO: 11515 - protein, 289 aa, Homo sapiens
MPEDLALESNPSDHPRASTIFLSKSQTDVREKRKSNHLNHVSPGQLTKKYSSCSTIFLDDSTVSQPNLRTTVKCVTLAIYYHIKNRDANRSLDIFDERSHPLTREKVPEEYFKHDPEHKFIYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLEAISRLCEDKDLCRAAMRRSFSADNFIGIQRSKAILS

SEQ ID NO: 11516 - protein, 361 aa, Homo sapiens
MGNILTCCVCPRASPGLHQHQGLVCHCESEIYEAAAGDLIAGVPVAAAVEPGEVTFVAGEGLHMHHICEREMPEDIPLEPNPSDHPKASTIFLRKSQTDVQEKKKKQLCKVSTEHFTQQYSSCSTIFLDDSIASQPHLTMTLKSCDLGTILSYQAKRDAHRSLGIFDEQLHPLTVRKEVLEEYFKYDPEHKLIFRFVRTLFKAMRLTAEFAIVSLIYIERLVSYADIDICPTNWKRIVLGAILLASKVWSDMAVWNEDYCKLFKNITVEEMNELERQFLKLINYNNSITNSVYSRFYFDLRTLAHNNGLYSPVYLLDRERAWKLEAFSRMEQDKVFYSAAKNGSLSADDLIHLQRAKAILF

SEQ ID NO: 11517 - protein, 287 aa, Homo sapiens
  MOD_RES (1)..(1): Any amino acid
XIPLEPNPSDHPKASTIFLRKSQTDVQEKKKKQLCKVSTEHFTQQYSSCSTIFLDDSIASQPHLTMTLKSCDLGTILSYQAKRDAHRSLGIFDEQLHPLTVRKEVLEEYFKYDPEHKLIFRFVRTLFKAMRLTAEFAIVSLIYIERLVSYADIDICPTNWKRIVLGAILLASKVWSDMAVWNEDYCKLFKNITVEEMNELERQFLKLINYNNSITNSVYSRFYFDLRTLAHNNGLYSPVYLLDRERAWKLEAFSRMEQDKVFYSAAKNGSLSADDLIHLQRAKAILF

SEQ ID NO: 11518 - protein, 343 aa, Homo sapiens
SCVVIQIPPWHLDRKYGSCSTILLDNSTASQPDLRHTLERYANRSLAIFEEPVHPLPQEKLPGKSFKHDPKRNCIFRHFCTLFQVIKLTAPCAIVALVYIKRLLTSANIDLCPTNWKKIVLGTMLLASKVWRNHGLWSVDDSQNSKDTAVENMSKMEKCFLELLEFNIHVSASVYAKYYFDLCALANDHDLYFLFSFLHKDKAQKLEGHTSQHSLSLGPCRVGMENYATYSPLSSQPVLGALSLAEVLPQEIKQEIHQVLMDHGVPCHYTCFLLHPEDSTLERFLVLHSIQGLQEDSVLCKVEIHGLSPQPQTYQSHFRSPSLAELLNRISGTCRNHFAGMQK

SEQ ID NO: 11519 - protein, 384 aa, Homo sapiens
MTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDEESLFTVSGVRLKPEMCDLLASYQKGHHPAQFSKCW

SEQ ID NO: 11520 - protein, 435 aa, Homo sapiens
MGQELCAKTVQPGCSCYHCSEGGEAHSCRRSQPETTEAAFKLTDLKEASCSMTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDEESLFTVSGVRLKPEMCDLLASYQKGHHPAQFSKCW

SEQ ID NO: 11521 - protein, 384 aa, Homo sapiens; identical to SEQ ID NO: 11519

SEQ ID NO: 11522 - protein, 400 aa, Homo sapiens
MGQELCAKTVQPGCSCYHCSEGGEAHSCRRSQPETTEAAFKLTDLKEASCSMTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDE

SEQ ID NO: 11523 - protein, 429 aa, Homo sapiens
MGQELCAKTVQPGCSCYHCSEGGEAHSCRRSQPETTEAAFKLTDLKEASCSMTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDVSGVRLKPEMCDLLASYQKGHHPAQFSKCW

SEQ ID NO: 11524 - protein, 570 aa, Homo sapiens
MPLYGRARDHVTHPSILGTRPGRPMAGPITAAVPEKICNGAFCSCSGAFPLDPNNPSLGPLPSISHLNLRTQIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 11525 - protein, 496 aa, Homo sapiens [sequence omitted]

SEQ ID NO: 11526 - protein, 502 aa, Homo sapiens
MQSEIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 11527 - protein, 496 aa, Homo sapiens [sequence omitted]

SEQ ID NO: 11528 - protein, 189 aa, Homo sapiens
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDN

SEQ ID NO: 11529 - protein, 150 aa, Homo sapiens
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLR

SEQ ID NO: 11530 - protein, 153 aa, Homo sapiens
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVS

SEQ ID NO: 11531 - protein, 57 aa, Homo sapiens
MDRMKKIKRQLSMTLRGGRGIDKTNGAPEQIGLDESGGGGGSDPGEAPTRAAPGELR

SEQ ID NO: 11532 - protein, 448 aa, Homo sapiens
MDRMKKIKRQLSMTLRSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 11533 - protein, 601 aa, Homo sapiens
MRGARRARRLGRWLFGPGIRRHSAIRPLCAASRREHSDSSRRQRVRGHRPQRPSSWPAERDAASASATAAAAASSSSAGGGPGPATMAEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRSLCPCGRLDSDGADLLTKLLQFEGRNRISAEDAMKHPFFLSLGERIHKLPDTTSIFALKEIQLQKEASLRSSSMPDSGRPAFRVVDTEF

SEQ ID NO: 11534 - protein, 523 aa, Homo sapiens
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINEKGELKLADFGLARAKSVPTKTYSNEVVTLWYRPPDVLLGSSEYSTQIDMWGVGCIFFEMASGRPLFPGSTVEDELHLIFRLLGTPSQETWPGISSNEEFKNYNFPKYKPQPLINHAPRLDSEGIELITKFLQYESKKRVSAEEAMKHVYFRSLGPRIHALPESVSIFSLKEIQLQKDPGFRNSSYPETGHGKNRRQSMLF

SEQ ID NO: 11535 - protein, 523 aa, Homo sapiens
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINEKGELKLADFGLARAKSVPTKTYSNEVVTLWYRPPDVLLGSSEYSTQIDMWGVGCIFFEMASGRPLFPGSTVEDELHLIFRLLGTPSQETWPGISSNEEFKNYNFPKYKPQPLINHAPRLDSEGIELITKFLQYESKKRVSAEEAMKHVYFRSLGPRIHALPESVSIFSLKEIQLQKDPGFRNSSYPETGVFVINHFTCRS

SEQ ID NO: 11536 - protein, 179 aa, Homo sapiens
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRA

SEQ ID NO: 11537 - protein, 88 aa, Homo sapiens
MKKFKRRLSLTLRGSQTIDESLSELAEQMTIEENSSKDNEPIVKNGRPPTSHSMHSFLHQYTGSFKKPPLRRPHSVIGGSLGSFMAMP

SEQ ID NO: 11538 - protein, 161 aa, Homo sapiens
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKL

SEQ ID NO: 11539 - protein, 474 aa, Homo sapiens
MIMNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 11540 - protein, 284 aa, Homo sapiens
MIMNKMKNFKRRFSLSVPRTETIEESLAEFTEQFNQLHNRRNENLQLGPLGRDPPQECSTFSPTDSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLA

SEQ ID NO: 11541 - protein, 474 aa, Homo sapiens; identical to SEQ ID NO: 11539

SEQ ID NO: 11542 - protein, 157 aa, Homo sapiens
MSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPR

SEQ ID NO: 11543 - protein, 504 aa, Homo sapiens
MIMNKMKNFKRRFSLSVPRTETIEESLAEFTEQFNQLHNRRNENLQLGPLGRDPPQECSTFSPTDSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 11544 - protein, 442 aa, Homo sapiens
MSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 11545 - protein, 502 aa, Homo sapiens
MDYDFKAKLAAERERVEDLFEYEGCKVGRGTYGHVYKARRKDGKDEKEYALKQIEGTGISMSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 11546 - protein, 441 aa, Homo sapiens
SLTRNIQLLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 11547 - protein, 378 aa, Homo sapiens
MDFVFNPLWKYLCLLAGKCIVLLVRPKLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 11548 - protein, 251 aa, Homo sapiens
MSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLL

SEQ ID NO: 11549 - protein, 126 aa, Homo sapiens
MSYKPIAPAPSSTPGSSTPGPGTPVPTGSVPSPSGSVPGAGAPFRPLFNDFGPPSMGYVQAMKPPGAQGSQSTYTDLLSVIEEMGKEIRPTYAGSKSAMERLKRGIIHARALVRECLAETERNART

SEQ ID NO: 11550 - protein, 358 aa, Homo sapiens
MMEKYEKIGKIGEGSYGVVFKCRNRDTGQIVAIKKFLESEDDPVIKKIALREIRMLKQLKHPNLVNLLEVFRRKRRLHLVFEYCDHTVLHELDRYQRGVPEHLVKSITWQTLQAVNFCHKHNCIHRDVKPENILITKHSVIKLCDFGFARLLTGPSDYYTDYVATRWYRSPELLVGDTQYGPPVDVWAIGCVFAELLSGVPLWPGKSDVDQLYLIRKTLGDLIPRHQQVFSTNQYFSGVKIPDPEDMEPLELKFPNISYPALGLLKGCLHMDPTQRLTCEQLLHHPYFENIREIEDLAKEHNKPTRKTLRKSRKHHCFTETSKLQYLPQLTGSSILPALDNKKYYCDTKKLNYRFPNI

SEQ ID NO: 11551 - protein, 248 aa, Homo sapiens
MEAPEGGGGGPAARGPEGQPAPEARVHFRVARFIMEAGVKLGMRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKYLLHYLVSLQNWLNRHSWQRTPVAVTAWALLRDSYHGALCLRFQAQHIAVAVLYLALQVYGVEVPAEVEAEKPWWQVFNDDLTKPIIDNIVSDLIQIYTMDTEIP

SEQ ID NO: 11552 - protein, 377 aa, Homo sapiens
MELSVLLFLALLTGLLLLLVQRHPNSHGTLPPGPRPLPLLGNLLQMDRRGLLKSFLRFREKYGDVFTVHLGPRPVVMLCGVEAIREALVDNAEAFSGRGKIVIMDPVYQGYGMLFANGNRWKVLRRFSVTTMRDFGMGKRSVEERIQDEAQCLIEELRKSKGALVDPTFLFHSITANIICSIIFGKRFHYQDQEFLKTLNLFCQSFLLISSISSQLFELFSGFLKYFPGAHRQVYKNLQEINAYIGHSVEKHRETLDPSAPRDLIDTYLLHMEKEKSNPHSEFSHQNLIINTLSLFFAGTETTSTTLRYGFLLMLKYPHVAERVYKEIEQVVGPHRPPALDDRAKMPYTEAVIREIQRFADLLPMGVPHIVTQHTSF

SEQ ID NO: 11553 - protein, 332 aa, Homo sapiens
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKTYQGLESLEEVCVYHSGVPIFHEGMKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDATTD

SEQ ID NO: 11554 - protein, 313 aa, Homo sapiens
MALLCYNRGCGQRFDPETNSDDACTYHPGVPVFHDALKGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKTYQGLESLEEVCVYHSGVPIFHEGMKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDATTD

SEQ ID NO: 11555 - protein, 520 aa, Homo sapiens
MSIPLKSSFLLSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 11556 - protein, 582 aa, Homo sapiens
HGLRATEALPSVRTTLRSLGLAPTCQARPPAGSLAARRLLQAPAHPANPTAAAAPTGTEATSQMWATHSGRPRSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 11557 - protein, 346 aa, Homo sapiens
MADSEALPSLAGDPVAVEALLRAVFGVVVDEAIQKGTSVSQKCHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 11558 - protein, 346 aa, Homo sapiens; identical to SEQ ID NO: 11557

SEQ ID NO: 11559 - protein, 454 aa, Homo sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGISALCHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 11560 - protein, 493 aa, Homo sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 11561 - protein, 152 aa, Homo sapiens [sequence omitted]

SEQ ID NO: 11562 - protein, 267 aa, Homo sapiens
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKEVGKRHRPNPGLLILISSHVTTPSRRELRFWDLAPTVSEWSRLMREGKWSPRIWRGRLVWPRLRVLCRSWSVPPLAPLC

SEQ ID NO: 11563 - protein, 99 aa, Homo sapiens
MSSQQSAVSAKGFSKGSSQGPAPCPAPAPTPAPASSSSCCGSGRGCCGDSGCCGSSSTSCCCFPRRRRRQRSSGCCCCGGGSQRSQRSNNRSSGCCSGC

SEQ ID NO: 11564 - protein, 123 aa, Homo sapiens
MASHVECRPLGVFECELCTLTAPYSYVGQKPPNTQSMVLLEESYVMKDPFTSDKDRFLVLGSCCSLCSRLVCVGPECSLFYSKRFCLPCVRENINAFPQEIRQDLEKRKAPSKRTPSQPGSRT

SEQ ID NO: 11565 - protein, 514 aa, Homo sapiens
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 11566 - protein, 316 aa, Homo sapiens
MVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 11567 - protein, 153 aa, Homo sapiens
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNGLLEAAKMPR

SEQ ID NO: 11568 - protein, 501 aa, Homo sapiens
MDENNGLLLLELNPPNPWDLQPRSPEELAFGEVQITYLTHACMDLKLGDKRMVFDPWLIGPAFARGWWLLHEPPSDWLERLCQADLIYISHLHSDHLSYPTLKKLAGRRPDIPIYVGNTERPVFWNLNQSGVQLTNINVVPFGIWQQVDKNLRFMILMDGVHPEMDTCIIVEYKGHKILNIVDCTRPNGGRLPMKVALMMSDFAGGASGFPMTFSGGKFTEEWKAQFIKTERKKLLNYKARLVKNLQPRIYCPFAGYFVESHPSDKYIKETNTKNDPNELNNLIKKNSDVITWTPRPGATLDLGRMLKDRTDSKGIIEPPEGTKIYKDSWDFEPYLEILNAALGDEIFLHSSWIKEYFTWAGFKDYNLVVRMIETDEDFNPFPGGYDYLVDFLDLSFPKERPQREHPYEEIHSRVDVIRHVVKNGLLWDELYIGFQTRLQRDPDIYHHLFWNHFQIKLPLTPPNWKSFLMCCEQNGPVILQFSTERTNEPNRNKFSVENKA

SEQ ID NO: 11569 - protein, 486 aa, Homo sapiens [sequence omitted]

SEQ ID NO: 11570 - protein, 220 aa, Homo sapiens
MDENNGLLLLELNPPNPWDLQPRSPEELAFGEVQITYLTHACMDLKLGDKRMVFDPWLIGPAFARGWWLLHEPPSDWLERLCQADLIYISHLHSDHLSYPTLKKLAGRRPDIPIYVGNTERPVFWNLNQSGVQLTNINVVPFGIWQQVDKNLRFMILMDGVHPEMDTCIIVEYKGHKILNIVDCTRPNGGRLPMKVALMMSDFAGGASGFPMTFSGGKFT

SEQ ID NO: 11571 - protein, 226 aa, Homo sapiens
MDENNGLLLLELNPPNPWDLQPRSPEELAFGEVQITYLTHACMDLKLGDKRMVFDPWLIGPAFARGWWLLHEPPSDWLERLCQADLIYISHLHSDHLSYPTLKKLAGRRPDIPIYVGNTERPVFWNLNQSGVQLTNINVVPFGIWQQVDKNLRFMILMDGVHPEMDTCIIVEYKGHKILNIVDCTRPNGGRLPMKVALMMSDFAGGASGFPMTFSGGKFTAEETLI

SEQ ID NO: 11572 - protein, 501 aa, Homo sapiens; identical to SEQ ID NO: 11568

SEQ ID NO: 11573 - protein, 173 aa, Homo sapiens
MDENNGLLLLELNPPNPWDLQPRSPEELAFGEVQITYLTHACMDLKLGDKRMVFDPWLIGPAFARGWWLLHEPPSDWLERLCQADLIYISHLHSDHLSYPTLKKLAGRRPDIPIYVGNTERPVFWNLNQSGVQLTNINVVPFGIWQQVDKNLRFMILMDGVHPEMDTCIIVEY

SEQ ID NO: 11574 - protein, 228 aa, Homo sapiens
MPRRGLVAGPDLEYFQRRYFTPAEVAQHNRPEDLWVSYLGRVYDLTSLAQEYKGNLLLKPIVEVAGQDISHWFDPKTRDIRKHIDPLTGCLRYCTPRGRFVHVPPQLPCSDWANDFGKPWWQGSYYEVGRLSAKTRSIRIINTLTSQEHTLEVGVLESIWEILHRYLPYNSHAASYTWKYEGKNLNMDFTLEENGIRDEEEEFDYLSMDGTLHTPAILLYFNDDLTEL

SEQ ID NO: 11575 - protein, 157 aa, Homo sapiens
MPRRGLVAGPDLEYFQRRYFTPAEVAQHNRPEDLWVSYLGRVYDLTSLAQEYKGNLLLKPIVEVAGQDISHWFDPKTRDIRKHIDPLTGCLRYCTPRGRFVHVPPQLPCSDWANDFGKPWWQGSYYEVGRLSAKTRSIRIINTLTSQEHTLEIHEEL

SEQ ID NO: 11576 - protein, 247 aa, Homo sapiens
MMAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRGIVDDLEIQRAYTPISPANAEGYFEVLIKCYQMGLMSRYVESWRVGDTAFWRGPFGDFFYKPNQESSSEQLPWSYQEKTHFGHLGQDLIKELVSCCRRKPFALVCGSAEFTKDIARCLLCAGLTEDSYFLF

SEQ ID NO: 11577 - protein, 167 aa, Homo sapiens
MGLMSRYVESWRVGDTAFWRGPFGDFFYKPNQYGELLLLAAGTGLAPMVPILQSITDNENDETFVTLVGCFKTFESIYLKTFLQEQARFWNVRTFFVLSQESSSEQLPWSYQEKTHFGHLGQDLIKELVSCCRRKPFALVCGSAEFTKDIARCLLCAGLTEDSYFLF

SEQ ID NO: 11578 - protein, 315 aa, Homo sapiens
MMAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRGIVDDLEIQRAYTPISPANAEGYFEVLIKCYQMGLMSRYVESWRVGDTAFWRGPFGDFFYKPNQYGELLLLAAGTGLAPMVPILQSITDNENDETFVTLVGCFKTFESIYLKTFLQEQARFWNVRTFFVLSQESSSEQLPWSYQEKTHFGHLGQDLIKELVSCCRRKPFALVCGSAEFTKDIARCLLCAGLTEDSYFLF

SEQ ID NO: 11579 - protein, 138 aa, Homo sapiens
MMAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRYTQVAGGPKLHSPALLFASCWP

SEQ ID NO: 11580 - protein, 315 aa, Homo sapiens; identical to SEQ ID NO: 11578

SEQ ID NO: 11581 - protein, 247 aa, Homo sapiens; identical to SEQ ID NO: 11576

SEQ ID NO: 11582 - protein, 315 aa, Homo sapiens; identical to SEQ ID NO: 11578

SEQ ID NO: 11583 - protein, 81 aa, Homo sapiens
MSRSSKVVLGLSVLLTAATVAGVHVKQQWDQQRLRDGVIRDIERQIRKKENIRLLGEQIILTEQLEAEREKMLLAKGSQKS

SEQ ID NO: 11584 - protein, 269 aa, Homo sapiens
GLLLVALLASLTVMVLMSVWQQRKSRGKLPLGPTPLLFIGNYLQLNTEHICDSIMKISERYGPVFTIHLGPRRVVVLCGHDAVKEALVDQAEEFSGRGEQATFDWLFKGYGVTCRTWERTKPLRRFSIATLRDFGVGKRGIKEIQEKAGFLIKAHQSSDSSIYPTFFLSRTTSNVISSIVFGDRFDYEDKFLSLLCMMLESFQFTAPSTGQLYEMFSSVMKHLPGPQQQAFKELQGLEDFIAKKVEHNQCTLDPNSPRDFIDSFLIRMQ

SEQ ID NO: 11585 - protein, 445 aa, Homo sapiens
MGLEALVPLAMIVAIFLLLVDLMHRHQRWAARYPPGPLPLPGLGNLHVDFQNTPYCFDQLRRRFGDVFSLQLAWTPVVVLNGLAAVREAMVTRGEDTADRPPAPIYQVLGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIIPLSVTHMTSHDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 11586 - protein, 443 aa, Homo sapiens
QEALTLPLQLRRRFGDVFSLQLAWTPVVVLNGLAAVREAMVTRGEDTADRPPAPIYQVLGFGPREQWVFLSRYGPAWREQRRFSVSTLRNLGLGKKSLEQWVTEEAACLCAAFADQDAPFAPTVSWTKPNVIASLTCGRRFEYDDPRFLRLLDLAQEGLKEESGFLREVLNAVPVLLHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIIPLSVTHMTSHDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 11587 - protein, 496 aa, Homo sapiens
MGLEALVPLAMIVAIFLLLVDLMHRHQRWAARYPPGPLPLPGLGNLHVDFQNTPYCFDQLRRRFGDVFSLQLAWTPVVVLNGLAAVREAMVTRGEDTADRPPAPIYQVLGFGPREQWVFLSRYGPAWREQRRFSVSTLRNLGLGKKSLEQWVTEEAACLCAAFADQAGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIIPLSVTHMTSHDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 11588 - protein, 407 aa, Homo sapiens
MVTRGEDTADRPPAPIYQVLGFGPRSQGVFLSRYGPAWREQRRFSVSTLRNLGLGKKSLEQWVTEEAACLCAAFADQAGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIIPLSVTHMTSHDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 11589 - protein, 142 aa, Homo sapiens
QLRRRFGDVFSLQLAWTPVVVQWAGGRARGDGDPRRGHGRPPACAHLPGDPLPASPTPRTPLSPQRSLGQSREQRDRLPHLRAPLRVRRPSLPQAAGPSSGGTEGGVGLPARGAECCPRPPAHPSAGWQGPTLPKGFPDPAG

SEQ ID NO: 11590 - protein, 169 aa, Homo sapiens
KIHEEINQVIGPHRLPRVDDRVKMPYTDVVIHEIQRLVDIVPMGVPHNIIQDTQFRGYLLPKGTDVFPLLGSVLKDPKYFRYPDAFYPQHFLDEQGRFKKNEAFVPFSSGKRICLGEAMARMELFLYFTSTLQNFSLCSLVPLVDIDITPKLSGFGNITPTYELCLVAR

SEQ ID NO: 11591 - protein, 372 aa, Homo sapiens
MRSVLRQRILKPKDVAIYSGEVNQVIADLIKRIYLLRSQAEDGETVTNVNDLFFKYSMEGVATILYESRLGCLENSIPQLTVEYIEALELMFSMFKTSMYAGAIPRWLRPFIPKPWREFCRSWDGLFKFSQIHVDNKLRDIQYQMDRGRRVSGGLLTYLFLSQALTLQEIYANVTEMLLAGVDTTSFTLSWTVYLLARHPEVQQTVYREIVKNLGERHVPTAADVPKVPLVRALLKETLRLFPVLPGNGRVTQEDLVIGGYLIPKGTQLALCHYATSYQDENFPRAKEFRPERWLRKGDLDRVDNFGSIPFGHGVRSCIGRRIAELEIHLVVIQLLQHFEIKTSSQTNAVHAKTHGLLTPGGPIHVRFVNRK

SEQ ID NO: 11592 - protein, 372 aa, Homo sapiens; identical to SEQ ID NO: 11591

SEQ ID NO: 11593 - protein, 118 aa, Homo sapiens
MVTPAGCLGGRNQGPREIPGTAFPRSSRAGQTGQAVSGAQVSSWRERQPCSGSRGPLHILGTDGNVDTTGKLGLVPTPPRIQKETKQGALCGMKPPFLPEALLIVWWLPFVAVSPCLF

SEQ ID NO: 11594 - protein, 397 aa, Homo sapiens
MEEDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 11595 - protein, 154 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRVVKTKWESV

SEQ ID NO: 11596 - protein, 428 aa, Homo sapiens
MNRQGNRKTTKEGSNDLKFQNFSLPKNRSWPRINSATGQYQRMNKPLLDWERNFAAVLDGAKGHSDDDYDDPELRMEETWQSIKILPARPIKESEYADTHYFKVAMDTPLPLDTRTSISIGQPTWNTQTRLERVDKPISKDVRSQNIKGDASVRKNKIPLPPPRPLITLPKKYQPLPPEPESSRPPLSQRHTFPEVQRMPSQISLRDLSEVLEAEKVPHNQRKPESTHLLENQNTQEIPLAISSSSFTTSNHSVQNRDHRGGMQPCSPQRCQPPASCSPHENILPYKYTSWRPPFPKRSDRKDVQHNEWYIGEYSRQAVEEAFMKENKDGSFLVRDCSTKSKEEPYVLAVFYENKVYNVKIRFLERNQQFALGTGLRGDEKFDSVEDIIEHYKNFPIILIDGKDKTGVHRKQCHLTQPLPLTRHLLPL

SEQ ID NO: 11597 - protein, 392 aa, Homo sapiens
MNPRGNRKTTKEGSNDLKFQNFSLPKNRSWPRINSATGQYQRMNKPLLDWERNFAAVLDGAKGHSDDDYDDPELRMEETWQSIKILPARPIKESEYADTHYFKVAMDTPLPLDTRTSISIGQPTWNTQTRLERVDKPISKDVRSQNIRPPLSQRHTFPEVQRMPSQISLRDLSESLEAKKVPHNQRKPESTHLLENQNTQEIPLAISSSSFTTSNHSVQNRDHRGGMQPCSPQRCQPPASCSPHENILPYKYTSWRPPFPKRSDRKDVQHNEWYIGEYSRQAVEEAFMKENKDGSFLVRDCSTKSKEEPYVLAVFYENKVYNVKIRFLERNQQFALGTGLRGDEKFDSVEDIIEHYKNFPIILIDGKDKTGVHRKQCHLTQPLPLTRHLLPL

SEQ ID NO: 11598 - protein, 169 aa, Homo sapiens
MNKPLLDWERNFAAVLDGAKGHSDDDYDDPELRMEETWQSIKILPARPIKESEYADTHYFKVAMDTPLPLDTRTSISIGQPTWNTQTRLERVDKPISKDVRSQNIKGDASVRKNKIPLPPPRPLITLPKKYQPLPPEPESSRPPLSQRHTFPEVQRMPSQISLRDLSEP

SEQ ID NO: 11599 - protein, 169 aa, Homo sapiens; identical to SEQ ID NO: 11598

SEQ ID NO: 11600 - protein, 564 aa, Homo sapiens
MPECLWTQGVLQEVLNSYFCGSIILSTLPWEVPGGHASRICLLLLATGENKQVECYQLSPGLSSLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 11601 - protein, 491 aa, Homo sapiens
MLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGNMPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 11602 - protein, 335 aa, Homo sapiens
MGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 11603 - protein, 561 aa, Homo sapiens
MSMPLEEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 11604 - protein, 486 aa, Homo sapiens
MLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 11605 - protein, 561 aa, Homo sapiens
MAFPLEEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 11606 - protein, 561 aa, Homo sapiens; identical to SEQ ID NO: 11605

SEQ ID NO: 11607 - protein, 376 aa, Homo sapiens
MLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 11608 - protein, 516 aa, Homo sapiens
MATRRLGVGETLGALNAALGPGGPVWIKETRTRHLRSRDFLAPHRALQARFDDGQVPEHLLHALACLQGPGVAPVLRCAPTPAGLSLQLQRSAVFERVLSAVAAYATPASPASLGQRVLLHCPALRSSPCALRLSQLRTVLVADHLARALRAHGVCVRLVPAVRDPHMLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEYPPLSGSAEPDSSAGLHSPGAPHCCTHRDDMQVPGTAQHGFQLLLQPGTHPGGASTTPLWSDVRPPAASESCA

SEQ ID NO: 11609 - protein, 168 aa, Homo sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 11610 - protein, 153 aa, Homo sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPVKEDQDHDREQGEEDNGDNNLERRGKM

SEQ ID NO: 11611 - protein, 86 aa, Homo sapiens
MNSKGQYPTQPTYPVQPPGNPVYPQTLHLPQAPPYTDAPPAYSEPPPPGCPPNAAQLAVMQGANVLVTQRKGNFFMGGSDGGYTIW

SEQ ID NO: 11612 - protein, 146 aa, Homo sapiens
MNSKGQYPTQPTYPVQPPGNPVYPQTLHLPQAPPYTDAPPAYSELYRPSFVHPGAATVPTMSAAIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 11613 - protein, 207 aa, Homo sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPASTSWMPSQCCSACSHAGSQRPRNSAEGELLHGWFRWWLHHLVRNQGHLCAGKDITYLQHFSQCNCFSHINLKLQFRHMLLGCLSGAQTFRHFSNLIRNHVMVAVPP

SEQ ID NO: 11614 - protein, 136 aa, Homo sapiens
MNSKGQYPTQPTYPVQPPGNPVYPQTLHLPQAPPYTDAPPAYSESVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 11615 - protein, 767 aa, Homo sapiens
MQSPAATAEGLSGPLFGAYTFPTFKFQPRHDSMDWRRISTLDVDRVARELDVATLQENIAGITFCNLDREVCSRCGQPVDPALLKVLRLAQLIIEYLLHCQDCLSASVAQLEARLQTSLGQQQRGQQELGRQADELKGVREESRRRRKMISTLQQLLMQTGTHSYHTCHLCDKTFMNATFLRGHIQRRHAGVAEGGKQKKQEQPVEEVLEELRAKLKWTQGELEAQREAERQRQLQEAELIHQREIEAKKEFDKWKEQEWTKLYGEIDKLKKLFWDEFKNVAKQNSTLEEKLRALQSHSVMESKLGSLRDEESEEWLRQARELQALREKTEIQKTEWKRKVKELHEEHMAEKKELQEENQRLQASLSQDQKKAAAQSQCQISTLRAQLQEQARIIASQEEMIQSLSLRKVEGIHKVPKAVDTEEDSPEEEMEDSQDEQHKVLAALRRNPTLLKHFRPILEDTLEEKLESMGIRKDAKGISIQTLRHLESLLRVQREQKARKFSEFLSLRGKLVKEVTSRAKERQENGAVVSQPDGQPSVKSQQSTLVTREAQPKTRTLQVALPSTPAEPPPPTRQSHGSHGSSLTQVSAPAPRPGLHGPSSTPPSSGPGMSTPPFSSEEDSEGDRVQRVSLQPPKVPSRMVPRPKDDWDWSDTETSEENAQPPGQGSGTLVQSMVKNLEKQLEAPAKKPAGGVSLFFMPNAGPQRAATPGRKPQLSEDESDLEISSLEDLPLDLDQREKPKPLSRSKLPEKFGTGPQSSGQPRVPAW

SEQ ID NO: 11616 - protein, 67 aa, Homo sapiens
MQSPAATAEGLSGPLFGAYTFPTFKFQPRHDSMDWRRISTLDVDRVARELDVATLQENIAGITFCNL

SEQ ID NO: 11617 - protein, 539 aa, Homo sapiens
MQSPAATAEGLSGPLFGAYTFPTFKFQPRHDSMDWRRISTLDVDRVARELDVATLQENIAGITFCNLDREVCSRCGQPVDPALLKVLRLAQLIIEYLLHCQDCLSASVAQLEARLQTSLGQQQRGQQELGRQADELKGVREESRRRRKMISTLQQLLMQTGTHSYHTCHLCDKTFMNATFLRGHIQRRHAGVAEGGKQKKQEQPVEEVLEELRAKLKWTQGELEAQREAERQRQLQEAELIHQREIEAKKEFDKWKEQEWTKLYGEIDKLKKLFWDEFKNVAKQNSTLEEKLRALQSHSVMESKLGSLRDEESEEWLRQARELQALREKTEIQKTEWKRKVKELHEEHMAEKKELQEENQRLQASLSQDQKKAAAQSQCQISTLRAQLQEQARIIASQEEMIQSLSLRKVEGIHKVPKAVDTEEDSPEEEMEDSQDEQHKVLAALRRNPTLLKHFRPILEDTLEEKLESMGIRKDAKGISIQTLRHLESLLRVQREQKARKFSEFLSLRGKLVKEVTSRAKERQENGAVVSQPDGQPSG

SEQ ID NO: 11618 - protein, 39 aa, Homo sapiens
MQSPAATAEGLSGPLFGAYTFPTFKFQPRHDSMDWRRIS

SEQ ID NO: 11619 - protein, 539 aa, Homo sapiens; identical to SEQ ID NO: 11617

SEQ ID NO: 11620 - protein, 186 aa, Homo sapiens
MHKLKSSQKDKVRQFMACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELKDTAKFKDFYQFTFTFAKNPGQKGLGSPPFLNVKALHH

SEQ ID NO: 11621 - protein, 259 aa, Homo sapiens
MHKLKSSQKDKVRQFMACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELKDTAKFKDFYQFTFTFAKNPGQKGLDLEMAVAYWKLVLSGRFKFLDLWNTFLMEHHKRSIPRDTWNLLLDFGNMIADDMSNYDEEGAWPVLIDDFVEYARPVVTGGKRSLF

SEQ ID NO: 11622 - protein, 237 aa, Homo sapiens
MPVKKKRKSPGVAAAVAEDGGLKKCKISSYCRSQPPARLISGEEHFSSKKCLAWFYEYAGPDEVVGPEGMEKFCEDIGVEPENIIMLVLAWKLEAESMGFFTKEEWLKGMTSLQCDCTEKLQNKFDFLRSQLNDISSFKNIYRYAFDFARDKDQRSLDIDTAKSMLALLLGRTWPLFSVFYQYLEQSKYRVMNKDQWYNVLEFSRTVHADLSNYDEDGAWPVLLDEFVEWQKVRQTS

SEQ ID NO: 11623 - protein, 582 aa, Homo sapiens
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAKRVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 11624 - protein, 522 aa, Homo sapiens
MFPFGPHSPGGDGSAGAGAEEPTPHEGQAAATGPPSPLHPGADATHPPPPARSPRRPGAPSLSPAPRSGELGLPGAPESSTASAPGEPSPPSPPCRRPGPDCRAKSRGRHGLGAGLGGPGARLFGWLKERSLGRGLFVDPARDNFRTMTSLYGSIHPADSVYLSTRTHGAVFNLEYSPDGSVLTVACEQTEVLLFDPISSKHIKTLSEAHEDCVNNIRFLDNRLFATCSDDTTIALWDLRKLNTKVCTLHGHTSWVKNIEYDTNTRLLVTSGFDGNVIIWDTNRYTEDGCPHKKFFHTRFLMRMRLTPDCSKMLISTSSGYLLILHDLDLTKSLEVGSYPILRARRTTSSSGVSPRNSLEVVTPEVLGESDHGNCITSLQLHPKGWATLLRCSSNSDDEECTCVYEFQEGAPVRPVSPRCSLRLTHYIEEANVGRGYIKELCFSPDGRMISSPHGYGIRLLGFDKQCSELVDCLPKEASPLRVIRSLYSHNDVVLTTKFSPTHCQIASGCLSGRVSLYQPKF

SEQ ID NO: 11625 - protein, 559 aa, Homo sapiens
MFPFGPHSPGGDGSAGAGAEEPTPHEGQAAATGPPSPLHPGADATHPPPPARSPRRPGAPSLSPAPRSGELGLPGAPESSTASAPGEPSPPSPPCRRPGPDCRAKSRGRHGLGAGLGGPGARLFGWLKERSLGRGLFVDPARDNFRTMTSLYGSIHPADSVYLSTRTHGAVFNLEYSPDGSVLTVACEQTEVLLFDPISSKHIKTLSEAHEDCVNNIRFLDNRLFATCSDDTTIALWDLRKLNTKVCTLHGHTSWVKNIEYDTNTRLLVTSGFDGNVIIWDTNRYTEDGCPHKKFFHTRFLMRMRLTPDCSKMLISTSSGYLLILHDLDLTKSLEVGSYPILRARRTTSSSDLTTSSSSSGPRVSGSPCHHSDSNSSEKHMSRASQREGVSPRNSLEVVTPEVLGESDHGNCITSLQLHPKGWATLLRCSSNSDDEECTCVYEFQEGAPVRPVSPRCSLRLTHYIEEANVGRGYIKELCFSPDGRMISSPHGYGIRLLGFDKQCSELVDCLPKEASPLRVIRSLYSHNDVVLTTKFSPTHCQIASGCLSGRVSLYQPKF

SEQ ID NO: 11626 - protein, 463 aa, Homo sapiens
MAQQQTGSRKRKAPAVEADAESSPSQGLAAADGEGPLLLKRQRRPATYRSMAHYLKVREVGGWGPARLQGFDGELRGYAVQRLPELLTERQLELGTVNKVFASQWLNSRQVVCGTKCNTLFVVDVESGHIARIPLLRDSEARLAQDQQGCGIHAIELNPSKTLLATGGENPNSLAIYQLPSLDPLCLGDRHGHKDWIFAVAWLSDTVAVSGSRDGTVALWRMDPDKFDDTVAWHSEVGLPVYAHIRPRDVEAIPRAIINPSNRKVRALACGGKNQELGAVSLDGYFHLWKAGSALSRLLSIRLPYFRDNVCLTYCDDMSVYAVGSHSHVSFLDLRQDQQNIRPLCSREGGTGVRSLSFYRHIITVGTGQGSLLFYDVRAQKFLEERASATLESSSGPARRKLRLACGRGWLNHNDFWVNYFGGMEVFPNALYTHCYNWPEMKLFVAGGPLPAGLHGNYAGLWS

SEQ ID NO: 11627 - protein, 463 aa, Homo sapiens
MAQQQTGSRKRKAPAVEAGAGSSSSQGLAAADGEGPLLPKKQKRPATRRRLVHYLKGREVGARGPAGLQGFEGELRGYAVQRLPELLTERQLDLGTLNKVFASQWLNARQVVCGTKCNTLFVVDVQSGHITRIPLMRDKEAGLAQAHQGCGIHAIELNPSKTLLATGGENPNSLAIYQLPTLDPLCLGDRHGHKDWIFAVAWLSDTVAVSGSRDGTVALWRMDPDMFNGSIAWHSEVGLPVYAHIRPRDVEAIPRASTNPSNRKVRALAFSGKNQELGAVSLDGYFHLWKARSTLSRLLSIRLPYCRENVCLTYCDELSLYAVGSQSHVSFLDPRQRQQNIRPLCSREGGTGVRSLSFYQHIITVGTGHGSLLFYDIRAQKFLEERASSSLDSMPGPAGRKLKLACGRGWLNQDDVWVNYFGGMGEFPNALYTHCYNWPEMKLFVAGGPLPSGLHGNYAGLWS

SEQ ID NO: 11628 - protein, 463 aa, Homo sapiens; identical to SEQ ID NO: 11627

SEQ ID NO: 11629 - protein, 600 aa, Homo sapiens
MAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 11630 - protein, 216 aa, Homo sapiens
MGPRNPSPDHLSESESEEEENISYLNESSGEEWDSSEEEDSMVPNLSPLESLAWQVKCLLKYSTTWKPLNPNSWLYHAKLLDPSTPVHILREIGLRLSHCSHCVPKLEPIPEWPPLASCGVPPFQKPLTSPSRLSRDHATLNGALQFATKQLSRTLSRATPIPEYLKQIPNSCVSGCCCGWLTKTVKETTRTEPINTTYSYTDFQKAVNKLLTASL

SEQ ID NO: 11631 - protein, 216 aa, Homo sapiens; identical to SEQ ID NO: 11630

SEQ ID NO: 11632 - protein, 495 aa, Homo sapiens
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 11633 - protein, 395 aa, Homo sapiens
MESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 11634 - protein, 435 aa, Homo sapiens
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKADTNSDRLFTVNDVKVGGSKYGIINLQSLKTPTLKVFMHENLYFTNRKVNSVCWASLNHLDSHILLCLMGLAETPGCATLLPASLFVNSHPAGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 11635 - protein, 489 aa, Homo sapiens
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPAGIDRPGMLCSFRIPGAWSCAWSLNIQANNCFSTGLSRRVLLTNVVTGHRQSFGTNSDVLAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 11636 - protein, 396 aa, Homo sapiens
MEAERLRLLEEEAKLKKVARMGFNASSMLRKSQLGFLNVTSYSRLANELRVSCMERKKVQIRSLDPSSLASDRFNFILASTNSDQLFVVNQVEVEGSKYGIISLRTLKIPSFHVYVLRNLYVPNRKVKSLCWASLNQLDSHVLLCFEGITDAPSCAVLLPASRFLSVHTRVNQPGMLCSFQIPEAWSCAWSLNTRAYHCFSAGLSQQVLLTSVATGHQQSFDTSSDVLAQQFASTAPLLFNGCRSGEIFAIDLRCRNRGKGWRATRLFHDSAVTSVQILQEEQCLMASDMTGKIKLWDLRATKCVRQYEGHVNESAYLPLHVHEEEGIVVAVGQDCYTRIWSLHDAHLLRTIPSPYSASEDDIPSVAFASRLGGIRGAAPGLLMAVRQDLYCFPFS

SEQ ID NO: 11637 - protein, 395 aa, Homo sapiens
MESKRPRLLEEADKQKKTVRVGLNAPSMLRKNQLGFLRFANYCRIARELRVSCMQRKKVQIHSWDPSSLASDRFNRILANTNTDQLFTVNQVEAGGSKYGIITMRGLTTPELRVYPHKTLYVPNRKVNSMCWASLNHLDSHLLLCFVGLADTPSCAVLLPASLFIGSFPGMRRPGMLCSFQIPDAWSCAWSLSIHAYHSFSTGLSQQVLLTNVVTGHQQSFGTSSDVLAQQFAIMTPLLFNGCRSGEIFGIDLRCGNQGSGWKAICLSHDSAVTSLQILQDGQFLVSSDMTGTIKLWDLRATKCVTQYEGHVNNSAYLPVHVNEEEGVVAAVGQDCYTRIWSLRHGHLLTTIPSPYPASENDIPSVAFSSRLGGFRGAPGLLMAVREDLYCFSYG

SEQ ID NO: 11638 - protein, 600 aa, Homo sapiens
MSHQEGSTGGLPDLVTESLFSSPEEQSGVAAVTAASSDIEMAATEPSTGDGGDTRDGGFLNDASTENQNTDSESSSEDVELESMGEGLFGYPLVGEETEREEEEEEMEEEGEEEEQPRMCPRCGGTNHDQCLLDEDQALEEWISSETSALPRSRWQVLTALRQRQLGSSARFVYEACGARTFVQRFRLQYLLGSHAGSVSTIHFNQRGTRLASSGDDLRVIVWDWVRQKPVLNFESGHDINVIQAKFFPNCGDSTLAMCGHDGQVRVAELINASYCENTKRVAKHRGPAHELALEPDSPYKFLTSGEDAVVFTIDLRQDRPASKVVVTRENDKKVGLYTISMNPANIYQFAVGGHDQFVRIYDQRRIDKKENNGVLKKFTPHHLVYCDFPTNITCVVYSHDGTELLASYNDEDIYLFNSSLSDGAQYVKRYKGHRNNDTIKCVNFYGPRSEFVVSGSDCGHVFFWEKSSSQIIQFMEGDRGDIVNCLEPHPYLPVLATSGLDQHVRIWTPTAKTATELTGLKDVIKKNKQERDEDNLNYTDSFDNRMLRFFVRHLLQRAHQPGWRDHGAEFPDEEELDESSSTSDTSEEEGQDRVQCIPS

SEQ ID NO: 11639 - protein, 631 aa, Homo sapiens
MSHQEGSTDGLPDLGTESLFSSPEEQSGAVAATEASSDIDIATSELSVTVTGDGSDSRDGGFPNDASTENRSSDQESASEDIELESLEDFEHFLMSGESLFHYPLVGEEETEREEEDEEIQEEGGEEEEEEEEEEEEEEEEEEEEEEQPRAGPQGSGGNHEQYSLEEDQALEEWVSSETSALPRPRWQVVTALHQRQLGSRPRFVYEACGARAFVQRFRLQYRLADHVGCVNTVHFNQRGTRLASSGDDLKVIVWDWVRQRPVLNFESGHTNNVFQAKFLPNCGDSTLAMCARDGQVRVAELINASYFNNTKCVAQHRGPAHKLALEPDSPYKFLTSGEDAVVFTIDLRQDRPASKVVVTRENDKKVGLYTITVNPANTYQFAVGGQDQFVRIYDQRKIDKKENNGVLKKFTPHHLVNCDFPTNITCVVYSHDGTELLASYNDDDIYLFNSSHSDGAQYSKRFKGHRNNTTVKGVNFYGPRSEFVVSGSDCGHIFFWEKSSCQIIQFLKGSREGTINCLEPHPYLPVLACSGLDHDVKIWTPTAKAATELTGLKKVIKKNKWERDEDSLHHGSLFDQYMLWFLLRHVTQRGRHQDWRSGEAEFPDEESDESSSTSETSEEEVQDRVQCMPS

SEQ ID NO: 11640 - protein, 483 aa, Homo sapiens
MSTARTENPVIMGLSSQNGQLRGPVKPTGGPGGGGTQTQQQMNQLKNTNTINNGTQQQAQSMTTTIKPGDDWKKTLKLPPKDLRIKTSDVTSTKGNEFEDYCLKRELLMGIFEMGWEKPSPIQEESIPIALSGRDILARAKNGTGKSGAYLIPLLERLDLKKDNIQAMVIVPTRELALQVSQICIQVSKHMGGAKVMATTGGTNLRDDIMRLDDTVHVVIATPGRILDLIKKGVAKVDHVQMIVLDEADKLLSQDFVQIMEDIILTLPKNRQILLYSATFPLSVQKFMNSHLQKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSNIDKSLYVAEYHSEPVEDEKP

SEQ ID NO: 11641 - protein, 483 aa, Homo sapiens
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 11642 - protein, 254 aa, Homo sapiens
MDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGADQPPLPPGAWTSLRYRWSSTTTPPGSPRSTSTESAGRPVQGGRVRPSRW

SEQ ID NO: 11643 - protein, 600 aa, Homo sapiens
MEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNASAFVHRCGRTARIGHGGSALVFLLPMEESYINFLAINQKCPLQEMKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 11644 - protein, 353 aa, Homo sapiens
MEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNAVLPC

SEQ ID NO: 11645 - protein, 619 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQIGRVGRLGQNGTAITFINNNSKRLFWDIAKRVKPTGSILPPQLLNSPYLHDQKRKEQQKDKQTQNDLVTGANLMDIIRKHDKSNSQK

SEQ ID NO: 11646 - protein, 205 aa, Homo sapiens
MKTVLLVGGLPLPPQLYRLQQHVKDKKLFKPPVLVFVDCKLGADLLSEAVQKITGLKSISIHSEKSQIERKNILKGLLEGDYEVVVSTGVLGRGLDLISVRLVVNFDMPSSMDEYVHQIGRVGRLGQNGTAITFINNNSKRLFWDIAKRVKPTGSILPPQLLNSPYLHDQKRKEQQKDKQTQNDLVTGANLMDIIRKHDKSNSQK

SEQ ID NO: 11647 - protein, 567 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQLNIIWVVPFSGININASLIALLYSLLTTINMKFTP

SEQ ID NO: 11648 - protein, 161 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESP

SEQ ID NO: 11649 - protein, 580 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQENTYKSTWRNPQHFQQDVRMTLGYVGKAQWEEDNQLKVKLGLKKNCSS

SEQ ID NO: 11650 - protein, 1706 aa, Homo sapiens
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFPELLSLRTALILHLQHNTNIDVQTEFSGCLSQDWKLFLEQHYPYFLIVSEEGLSDLQTYLFNFLIIHSWGMKVNVVLSSGHESDTLRFYAYTMESTDRNQTFSKENETVIQSAYKSLIQHLEEIRVLVLATHFEHLKWNDMMEEAYQTLFLLQHLWSEGSDIQRVLCVTSCSLSLRMYHRVLVHSNCLSLQEVEDFCRLRCLCVAFQLHLPLSQRACSRVITCSWIRNSDSFLKMNKWCEYFILSNLNVFGCWNLNLNHVSDLYDEQLLKNIAFYYEFESTQEPHLNLGDSIRRDYEDLWNVVSHLVKEFNVGKSFPLRTTRRHFLRQEKSVIQEISLEKMPSVGFIPMTSAVIDEFVGDMMKDLPILKSDDPVVPSLFKQKTSDELLHWHAQRLLSDDYDRIKCHVDEQSRDPHVLDFLKKIQDYQQFYGKSLESISTKVIVTQTTRPKEDSSGASGEILQNTKPHQITKKSKKKSFLKEDQNKAQQNDDLLFSIEEEMKNNLHSGIRKLEDYLTSCASNSVKFGVEMLGLIACFKAWKKHCRGEGKISKDLSIAVQMMKRIHSLLERYPEILEAEHHQYIAKCLKYLGFNDLANSLDPTLIGDDKNKKKYSIDIGPARFQLQYMGHYLIRDERKDRDPRVQDFIPNAWQQELLDVVDKNESAVIVAPTSSGKTYASYYCMEKVLRESDVGVVVYVAPAKSLVGQVAATVENRFTKTLPAGRTLCGAFTRDYCHNVLNCQVLITVPECFEILLLAPHRQKWVERIRYVIFDEVHYLGREVGAKFWELLLVIIRCPFLVLSATINNPNLLTKWLQSVKQYWKQADKIMEEKCISEKQADKCLNFLQDHSYKNQSYEVRLVLYGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRITKKNPKKAEKLERKKVYRAEYINFLENLKILEISEDCTYADVKALHTEITRNKDSTLERVLPRVRFTRHGKELKALAQRGIGYHHSSMYFKEKEFVEILFVKGLIRVVTATETLALGIHMPCKSVVFAQDSVYLDALNYRQMSGRAGRRGQDLLGNVYFFDIPLPKIKRLLASSVPELRGQFPLSITLVLRLMLLASKGDDPEDAKAKVLSVLKHSLLSFKRRRAMETLKLYFLFSLQLLIKEDYLNKKGNPKKFAGLASYLHGHEPSNLVFVNFLKRGLFHNLCKPAWKGSQQFSQDVMEKLVLVLANLFGRKYIPAKFQNANLSFSQSKVILAELPEDFKAALYEYNLAVMKDFASFLLIASKSVNMKKEHQLPLSRIKFTGKECEDSQLVSHLMSCKKGRVAISPFVCLSGNTDNDLLRPETINQVILRTVGVSGTQAPLLWPWKLDNRGRRMPLNAYVLNFYKHNCLTRLDQKNGMRMGQLLKCLKDFAFNIQAISDSLSELCENKRDNVVLAFKQLSQTFYEKLQEMQIQMSQNHLE

SEQ ID NO: 11651 - protein, 125 aa, Homo sapiens
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFPELLSLRTALILHLQHNTNIDVQTEFSG

SEQ ID NO: 11652 - protein, 1308 aa, Homo sapiens
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFPELLSLRTALILHLQHNTNIDVQTEFSGCLSQDWKLFLEQHYPYFLIVSEEGLSDLQTYLFNFLIIHSWGMKVNVVLSSGHESDTLRFYAYTMESTDRNQTFSKENETVIQSAYKSLIQHLEEIRVLVLATHFEHLKWNDMMEEAYQTLFLLQHLWSEGSDIQRVLCVTSCSLSLRMYHRVLVHSNCLSLQEVEDFCRLRCLCVAFQLHLPLSQRACSRVITCSWIRNSDSFLKMNKWCEYFILSNLNVFGCWNLNLNHVSDLYDEQLLKNIAFYYEFESTQEPHLNLGDSIRRDYEDLWNVVSHLVKEFNVGKSFPLRTTRRHFLRQEKSVIQEISLEKMPSVGFIPMTSAVIDEFVGDMMKDLPILKSDDPVVPSLFKQKTSDELLHWHAQRLLSDDYDRIKCHVDEQSRDPHVLDFLKKIQDYQQFYGKSLESISTKVIVTQTTRPKEDSSGASGEILQNTKPHQITKKSKKKSFLKEDQNKAQQNDDLLFSIEEEMKNNLHSGIRKLEDYLTSCASNSVKFGVEMLGLIACFKAWKKHCRGEGKISKDLSIAVQMMKRIHSLLERYPEILEAEHHQYIAKCLKYLGFNDLANSLDPTLIGDDKNKKKYSIDIGPARFQLQYMGHYLIRDERKDRDPRVQDFIPNAWQQELLDVVDKNESAVIVAPTSSGKTYASYYCMEKVLRESDVGVVVYVAPAKSLVGQVAATVENRFTKTLPAGRTLCGAFTRDYCHNVLNCQVLITVPECFEILLLAPHRQKWVERIRYVIFDEVHYLGREVGAKFWELLLVIIRCPFLVLSATINNPNLLTKWLQSVKQYWKQADKIMEEKCISEKQADKCLNFLQDHSYKNQSYEVRLVLYGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRISTKKNPKKAEKLERKKVYRAEYINFLENLKILEISEDCTYADVKALHTEITRNKDSTLERVLPRVRFTRHGKELKALAQRGIGYHHSSMYFKEKEFVEILFVKGLIRVVTATETLALGIHMPCKSVVFAQDSVYLDALNYRQIM

SEQ ID NO: 11653 - protein, 1706 aa, Homo sapiens; identical to SEQ ID NO: 11650

SEQ ID NO: 11654 - protein, 77 aa, Homo sapiens
MGSKDHAVFFREMTQLILNEMPKAGYSSILNDFVESNFFVIDGDSLLVTCLGVKSFKWGQNLHFFYLVECYLVDLLS

SEQ ID NO: 11655 - protein, 98 aa, Homo sapiens
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFP

SEQ ID NO: 11656 - protein, 861 aa, Homo sapiens
MPILLFLIDTSASMNQRTDLGTSYLDIAKGAVELFLKLRARDPASRGDRYMLVTYDEPPYCIKAGWKENHATFMSELKNLQASGLTTLGQALRSSFDLLNLNRLISGIDNYGQGRNPFFLEPSILITITDGNKLTSTAGVQEELHLPLNSPLPGSELTKEPFRWDQRLFALVLRLPGVASTEPEQLGSVPTDESAITQMCEVTGGRSYCVRTQRMLNQCLESLVQKVQSGVVINFEKTGPDPLPIGEDGLMDSSRPSNSFAAQPWHSCHKLIYVRPNSKTGVPVGHWPIPESFWPDQNLPSLPPRTSHPVVRFSCVDCEPMVIDKLPFDKYELEPSPLTQYILERKSPHTCWQVFVTSSGKYNELGYPFGYLKASTTLTCVNLFVMPYNYPVLLPLLDDLFKVHKLKPNLKWRQAFDSYLKTLPPYYLLTKLESERILASVGKKPPQEIGIKVKNHSGGGMSLTHNKNFRKLLKEITGETALRLTELNTKEFAGFQIGLLNKDLKPQTYRNAYDIPRRGLLDQLTRMRSNLLKTHKFIVGQDEDSLHSVPVAQMGNYQEYLKTLASPLREIDPDQPKRLHTFGNPFKQDKKGMMIDEADEFVAGPQNKVKRPGEPNSPMSSKRRRSMSLLLRKPQTPPTVTNHVGGKGPPSASWFPSYPNLIKPTLVHTDATIIHDGHEEKMENGQITPDGFLSKSAPSELINMTGDLMPPNQVDSLSDDFTSLSKDGLIQKPGSNAFVGGAKNCSLSVDDQKDPVASTLGAMPNTLQITPAMAQGINADIKHQLMKEVRKFGRKYERIFILLEEVQGPLEMKKQFVEFTIKEAARFKRRVLIQYLEKVLEKINSHHLHNNISHINSRSSC

SEQ ID NO: 11657 - protein, 1386 aa, Homo sapiens
MSSSVRRKGKPGKGGGKGSSRGGRGGRSHASKSHGSGGGGGGGGGGGGGNRKASSRIWDDGDDFCIFSESRRPSRPSNSNISKGESRPKWKPKAKVPLQTLHMTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDGDVGASLEHLLTQCFSETFGERMKISEAVNQISLDECMEQRQEEAFALKSICGEKFIERIQNRVWTIGLELEYLTSRFRKSKPKESTKNVQENSLEICKFYLKGNCKFGSKCRFKHEVPPNQIVGRIERSVDDSHLNAIEDASFLYELEIRFSKDHKYPYQAPLVAFYSTNENLPLACRLHISEFLYDKALTFAETSEPVVYSLITLLEEESEIVKLLTNTHHKYSDPPVNFLPVPSRTRINNPACHKTVIPNNSFVSNQIPEVEKASESEESDEDDGPAPVIVENESYVNLKKKISKRYDWQAKSVHAENGKICKQFRMKQASRQFQSILQERQSLPAWEERETILNLLRKHQVVVISGMTGCGKTTQIPQFILDDSLNGPPEKVANIICTQPRRISAISVAERVAKERAERVGLTVGYQIRLESVKSSATRLLYCTTGVLLRRLEGDTALQGVSHIIVDEVHERTEESDFLLLVLKDIVSQRPGLQVILMSATLNAELFSDYFNSCPVITIPGRTFPVDQFFLEDAIAVTRYVLQDGSPYMRSMKQISKEKLKARRNRTAFEEVEEDLRLSLHLQDQDSVKDAVPDQQLDFKQLLARYKGVSKSVIKTMSIMDFEKVNLELIEALLEWIVDGKHSYPPGAILVFLPGLAEIKMLYEQLQSNSLFNNRRSNRCVIHPLHSSLSSEEQQAVFVKPPAGVTKIIISTNIAETSITIDDVVYVIDSGKMKEKRYDASKGMESLEDTFVSQANALQRKGRAGRVASGVCFHLFTSHHYNHQLLKQQLPEIQRVPLEQLCLRIKILEMFSAHNLQSVFSRLIEPPHTDSLRASKIRLRDLGALTPDERLTPLGYHLASLPVDVRIGKLMLFGSIFRCLDPALTIAASLAFKSPFVSPWDKKEEANQKKLEFAFANSDYLALLQAYKGWQLSTKEGVRASYNYCRQNFLSGRVLQEMASLKRQFTELLSDIGFAREGLRAREIEKRAQGGDGVLDATGEEANSNAENPKLISAMLCAALYPNVVQVKSPEGKFQKTSTGAVRMQPKSAELKFVTKNDGYVHIHPSSVNYQVRHFDSPYLLYHEKIKTSRVFIRDCSMVSVYPLVLFGGGQVNVQLQRGEFVVSLDDGWIRFVAASHQVAELVKELRCELDQLLQDKIKNPSIDLCTCPRGSRIISTIVKLVTTQ

SEQ ID NO: 11658 - protein, 433 aa, Homo sapiens
MTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDGDVGASLEHLLTQCFSETFGERMKISEAVNQISLDECMEQRQEEAFALKSICGEKFIERIQNRVWTIGLELEYLTSRFRKSKPKESTKNVQENSLEICKFYLKGNCKFGSKCRFKHEVPPNQIVGRIERSVDDSHLNAIEDASFLYELEIRFSKDHKYPYQAPLVAFYSTNENLPLACRLHISEFLYDKALTFAETSEPVVYSLITLLEEESEIVKLLTNTHHKYSDPPVNFLPVPSRTRINNPACHKTVIPNNSFVSNQIPEVEKASESEESDEDDGPAPVIVENESYVNLKKKISKRYDWQAKSVHAENGKICKQFRMKQILQSHL

SEQ ID NO: 11659 - protein, 576 aa, Homo sapiens
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECCTPPASSLAAPRCCTHRSWRPATATEAETTRTR

SEQ ID NO: 11660 - protein, 1143 aa, Homo sapiens
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVVYQPQEAEPTTSKSEKLDPRPFLRVLESIDHKYPPEERGDLLVFLSGMAEISAVLEAAQTYASHTQRWVVLPLHSALSVADQDKVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRDDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 11661 - protein, 1157 aa, Homo sapiens
MGKLRRRYNIKGRQQAGPGPSKGPPEPPPVQLELEDKDTLKGVDASNALVLPGKKKKKTKAPPLSKKEKKPLTKKEKKVLQKILEQKEKKSQRAEMLQKLSEVQASEAEMRLFYTTSKLGTGNRMYHTKEKADEVVAPGQEKISSLSGAHRKRRRWPSAEEEEEEEEESESELEEESELDEDPAAEPAEAGVGTTVAPLPPAPAPSSQPVPAGMTVPPPPAAAPPLPRALAKPAVFIPVNRSPEMQEERLKLPILSEEQVIMEAVAEHPIVIVCGETGSGKTTQVPQFLYEAGFSSEDSIIGVTEPRRVAAVAMSQRVAKEMNLSQRVVSYQIRYEGNVTEETRIKFMTDGVLLKEIQKDFLLLRYKVVIIDEAHERSVYTDILIGLLSRIVTLRAKRNLPLKLLIMSATLRVEDFTQNPRLFAKPPPVIKVESRQFPVTVHFNKRTPLEDYSGECFRKVCKIHRMLPAGGILVFLTGQAEVHALCRRLRKAFPPSRARPQEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKVINFPFPTPPSVEALLAAEELLIALGALQPPQKAERVKQLQENRLSCPITALGRTMATFPVAPRYAKMLALSRQHGCLPYAITIVASMTVRELFEELDRPAASDEELTRLKSKRARVAQMKRTWAGQGASLKLGDLMVLLGAVGACEYASCTPQFCEANGLRYKAMMEIRRLRGQLTTAVNAVCPEAELFVDPKMQPPTESQVTYLRQIVTAGLGDHLARRVQSEEMLEDKWRNAYKTPLLDDPVFIHPSSVLFKELPEFVVYQEIVETTKMYMKGVSSVEVQWIPALLPSYCQFDKPLEEPAPTYCPERGRVLCHRASVFYRVGWPLPAIEVDFPEGIDRYKHFARFLLEGQVFRKLASYRSCLLSSPGTMLKTWARLQPRTESLLRALVAEKADCHEALLAAWKKNPKYLLAEYCEWLPQAMHPDIEKAWPPTTVH

SEQ ID NO: 11662 - protein, 616 aa, Homo sapiens
MCLEKRYLDVLSDVTGPQVSCYITAPSYVLQQLECRIINHMSSLIVGDNEELVSNVITIECSDKEKRVPFPIGIAIPFTARYRGNYRDIMVKVCDINLQSSYLNPNSLEGMKGGYKGTCASVKVYKLGIFSVVSCLKKESFTVTKKGLALKSSMDSRISLNYPPGVFTSPVLVQLKIQPVDPALVAHLKAQQDTFYSVQSTSPLIHIQHPSTYPFQKPVTLFLPCSPYLDKNNLGSEIDHKRRASATINRITPSYFNRTKIASIRKPRKNASECLKLLGFRSQDSGWCGLDDVVKTIQSGLVSVELYEHLERFIVLHLSSTMDNSHLVTFVKSLEEAMLSTTACIVLSHQKDNPHRIAVLVVPSKDLSQVLKDLHLEGFGGPPEPSRHFQVREGEQLLLRFTGNIFASSNGKDYGKDYTLIFHLQRKPRLELQIKEVDEFGNYSCPHYKGTIVVYKVPKGKIVPNLNQSLVINENHSQLPICKLPLKLPKHKKLINRPQSTKRVSKDPVEALWDNLLHWLAEELSEENAESLSSTLPLRRSTIQLIKLKNPDDLTEQIHEFLCFWKKSLPTFTDKLRLLARHLRKIGRSDLAEELKFKWENKVFTEPQQCFDVAPE

SEQ ID NO: 11663 - protein, 781 aa, Homo sapiens
MHDECTPQQTMSSIQDTKAADIAARGELNVIETATVSPTNGEESHYTNQVQLEKNKTHMSSALVEKENNTSLNGRVLGQEESQNKMFPDNAENEDDKQIEHMTVENINGNREETHGIIQTTETEIQETSESPREEMTTSSIICDISKKYINSTLPNDSENIKHKNNIMEKEYLDVLSDVTGPQVSCYITAPSYVLQQLECRIINHMSSLIVGDNEELVSNVITIECSDKEKRVPFPIGIAIPFTARYRGNYRDIMVKVCDINLQSSYLNPNSLEGMKGGYKGTCASVKVYKLGIFSVVSCLKKESFTVTKKGLALKSSMDSRISLNYPPGVFTSPVLVQLKIQPVDPALVAHLKAQQDTFYSVQSTSPLIHIQHPSTYPFQKPVTLFLPCSPYLDKNNLGSEIDHKRRASATINRITPSYFNRTKIASIRKPRKNASECLKLLGFRSQDSGWCGLDDVVKTIQSGLVSVELYEHLERFIVLHLSSTMDNSHLVTFVKSLEEAMLSTTACIVLSHQKDNPHRIAVLVVPSKDLSQVLKDLHLEGFGGPPEPSRHFQVREGEQLLLRFTGNIFASSNGKDYGKDYTLIFHLQRKPRLELQIKEVDEFGNYSCPHYKGTIVVYKVPKGKIVPNLNQSLVINENHSQLPICKLPLKLPKHKKLINRPQSTKRVSKDPVEALWDNLLHWLAEELSEENAESLSSTLPLRRSTIQLIKLKNPDDLTEQIHEFLCFWKKSLPTFTDKLRLLARHLRKIGRSDLAEELKFKWENKVFTEPQQCFDVAPE

SEQ ID NO: 11664 - protein, 2129 aa, Homo sapiens
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQDGKRMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 11665 - protein, 2109 aa, Homo sapiens
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLGTYTIASPPERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 11666 - protein, 2140 aa, Homo sapiens
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLGTYTIASPPERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQTTIWKRMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 11667 - protein, 932 aa, Homo sapiens
MFELSVPFRQQHYLAGLVLTELAVILDPDAEGLFGLHKKVINMVHNLLSSHDSDPRYSDPQIKARVAMLYLPLIGIIMETVPQLYDFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKATNYVLSFFSQRFLQSNEPSQNGSLECTCFIHLQRAMYSTSSVKRSIGKQHGMEFWKLLFIEECSGQENIKCRLLTLENHGYGF

SEQ ID NO: 11668 - protein, 632 aa, Homo sapiens
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPSPSCTHPIPTVRPLPLWCYHSIFSLLSWDFIT

SEQ ID NO: 11669 - protein, 1303 aa, Homo sapiens
  MOD_RES (1)..(1): Any amino acid
XKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 11670 - protein, 2093 aa, Homo sapiens
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQICPLEEKTSVLPNSLHIFNAISGTPTSTMVHGMTSSSSVV

SEQ ID NO: 11671 - protein, 424 aa, Homo sapiens
MMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQVSLLSILQTVLSPL

SEQ ID NO: 11672 - protein, 2102 aa, Homo sapiens
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQAAQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQVRRSAPWRRRRASYRIPFTSSTPSVGLQQAQWFTG

SEQ ID NO: 11673 - protein, 724 aa, Homo sapiens
MHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQICPLEEKTSVLPNSLHIFNAISGTPTSTMVHGMTSSSSVV

SEQ ID NO: 11674 - protein, 2094 aa, Homo sapiens
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQAAQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQVRRSAPWRRRRASYRIPFTSSTPSVGLQQAQWFTG

SEQ ID NO: 11675 - protein, 2068 aa, Homo sapiens
MQADKCRTSSRSVKKELVIESPLQYKDAAQGEVEAESPGPVPAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQAAQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQLG

SEQ ID NO: 11676 - protein, 1009 aa, Homo sapiens
MPFGKGRIQRYQAFLSPTVESNDTPVDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQAAQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQVRRSAPWRRRRASYRIPFTSSTPSVGLQQAQWFTG

SEQ ID NO: 11677 - protein, 669 aa, Homo sapiens
  MOD_RES (1)..(1): Any amino acid
XFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQICPLEEKTSVLPNSLHIFNAISGTPTSTMVHGMTSSSSVV

SEQ ID NO: 11678 - protein, 2079 aa, Homo sapiens
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQAAQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQVRRSAPWRRRRASYRIPFTSSTPSVGLQQAQWFTG

SEQ ID NO: 11679 - protein, 390 aa, Homo sapiens
  MOD_RES (1)..(1): Any amino acid
XQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQ

SEQ ID NO: 11680 - protein, 195 aa, Homo sapiens
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMR

SEQ ID NO: 11681 - protein, 2101 aa, Homo sapiens [sequence omitted]

SEQ ID NO: 11682 - protein, 1253 aa, Homo sapiens
MQADKCRTSSRSVKKELVIESPLQYKDAAQGEVEAESPGPVPAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIGNAPCSCGLLSTITLKVSWSQ

SEQ ID NO: 11683 - protein, 1393 aa, Homo sapiens
MGCTTSVILFKGIRTVFERNCAYMCKQQGENNALEYTAYNWTKEDSELLISSWLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASLTKCVALLLPAWNRNDACQIAAAGQPG

SEQ ID NO: 11684 - protein, 250 aa, Homo sapiens
ADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRN

SEQ ID NO: 11685 - protein, 116 aa, Homo sapiens
  MOD_RES (1)..(1): Any amino acid
XSELMDFFTISEVCLHQFQYMGKRYIARNQEGLGPIVHDRKSQTLPVSRNRTGMMHARLQQLGSLDNSLTFNHSYGHSDADVLHQSLLEANIATEVCLTALDTLSLFTLAFKNQLL

SEQ ID NO: 11686 - protein, 203 aa, Homo sapiens
RKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGK

SEQ ID NO: 11687 - protein, 373 aa, Homo sapiens
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFDAMVQGKVTPASLIHHTKLCLEKPLGPSVLRHAQQGGFSVKSLGDLMELVFLSLTLSDLPVIDILKIEYIHQETATVLGTEIVAFKEKEVRAKVQHYMAYWMGHREPQGVDVEEAWKCRTCTYADICEWRKGSGVLSSTLAPQVKKAK

SEQ ID NO: 11688 - protein, 373 aa, Homo sapiens; identical to SEQ ID NO: 11687

SEQ ID NO: 11689 - protein, 373 aa, Homo sapiens; identical to SEQ ID NO: 11687

SEQ ID NO: 11690 - protein, 161 aa, Homo sapiens
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEG

SEQ ID NO: 11691 - protein, 224 aa, Homo sapiens
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYI

SEQ ID NO: 11692 - protein, 247 aa, Homo sapiens
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFDAMVQGKVTPASLIHHTKLCLE

SEQ ID NO: 11693 - protein, 226 aa, Homo sapiens
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFD

SEQ ID NO: 11694 - protein, 100 aa, Homo sapiens
MAETREEETVSAEASGFSDLSDSEFLEFLDLEDAQESKALVNMPGPSSESLGKDDKPISLQNWKRGLDILSPMERFHLKYLYVTDLATQNWCELQTAYGK

SEQ ID NO: 11695 - protein, 247 aa, Homo sapiens; identical to SEQ ID NO: 11692

SEQ ID NO: 11696 - protein, 42 aa, Homo sapiens
CRSQKSCWIIKGHCRKNCKPGEQVKKPCKNGDYCCIPSNTDS

SEQ ID NO: 11697 - protein, 242 aa, Homo sapiens
MNLHVKTLSLMTWRSRFLEESFWSLEETAALAKQLPLKSPSENIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 11698 - protein, 271 aa, Homo sapiens
MNLHVKTLSLMTWRSRFLEESFWSLEETAALAKQLPLKSPSENIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPDRNEQELRKVVGEAQTASPLPRFLEIMMHEGKCQPQGHSSNDLEACWSSGGGEQNSLPDWPHQLHDLRQLTWALCSSFLLYKQGN

SEQ ID NO: 11699 - protein, 317 aa, Homo sapiens
MSLYRSVVWFAKGLREYTKSGYESACKDFVPHDLEVQIPGRVFLVTGGNSGIGKATALEIAKRGGTVHLVCRDQAPAEDARGEIIRESGNQNIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQDRKPVSTHLPLATASSSPAEEEKLIEILEQLAQTFK

SEQ ID NO: 11700 - protein, 232 aa, Homo sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 11701 - protein, 215 aa, Homo sapiens
MPFPCLSLPSSWDYRIGFAIARRLAQDRAHVVVSSRKQQNVDQAVATLQGEGLSVTGTVCHVGKAEDRERLVAMTLDINVKAPALMTKAVVPEMEKRGGGSVVIVSSIAAFSPSPGFSPYNVSKTALLGLNNTLAIELAPRNIRVNCLPGLIKTSFSRMLWMDKEKEESMKETLRIRRLGEPEDCAGIVSFLCSEDASYITGETVVVGGGTPSRL

SEQ ID NO: 11702 - protein, 257 aa, Homo sapiens
MARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGWLGEPEDCAGIVSFLCSEDASYITGETVVVGGGTPSRL

SEQ ID NO: 11703 - protein, 91 aa, Homo sapiens
MAVKLHGGIDILVSNAAVNPFFGSLMDVTEEVWDKLWMDKEKEESMKETLRIRRLGEPEDCAGIVSFLCSEDASYITGETVVVGGGTPSRL

SEQ ID NO: 11704 - protein, 57 aa, Homo sapiens
MLWMDKEKEESMKETLRIRRLGEPEDCAGIVSFLCSEDASYITGETVVVGGGTPSRL

SEQ ID NO: 11705 - protein, 155 aa, Homo sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKLWMDKEKEESMKETLRIRR

SEQ ID NO: 11706 - protein, 330 aa, Homo sapiens
MSPLSAARAALRVYAVGAAVILAQLLRRCRGGFLEPVFPPRPDRVAIVTGGTDGIGYSTAKHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDVYKHVFWATRLAKKLLGWLLFKTPDEGAWTSIYAAVTPELEGVGGHYLYNEKETKSLHVTYNQKLQQQLWSKSCEMTGVLDVTL

SEQ ID NO: 11707 - protein, 55 aa, Homo sapiens
MKMSFERCTARNKMFVNSAFTKVDNYCTFLMEKVLFKVLFLVEYYQKGKKNDLNF

SEQ ID NO: 11708 - protein, 55 aa, Homo sapiens; identical to SEQ ID NO: 11707

SEQ ID NO: 11709 - protein, 160 aa, Homo sapiens
MASPAPLVASISHQMVALQTLQLLQQEWGWGDGPVAPGNPRDPDHVSTAPARRSGPPRARPGPGREERGGGVGTRSRRTAARANSPEEEVVRGAEGGAELLPFPRDRGPCTLAQMAMRSALARVVDSTSELVSVEQTLLGPLQQERSFPIHLKLQLLANE

SEQ ID NO: 11710 - protein, 174 aa, Homo sapiens
MASPAPLVASISHQMVALQTLQLLQQEWGWGDAARANSPEEEVVRGAEGGAELLPFPRDRGPCTLAQMAMRSALARVVDSTSELVSVEQTLLGPLQQERSFPIHLKDSVEFRNICSHLALQIEGQQFDRDLNAAHQCLKTIVKKLIQSLANFPSDAHMVACASLRQILQNLPDI

SEQ ID NO: 11711 - protein, 221 aa, Homo sapiens
MASPAPLVASISHQMVALQTLQLLQQEWGWGDGPVAPGNPRDPDHVSTAPARRSGPPRARPGPGREERGGGVGTRSRRTAARANSPEEEVVRGAEGGAELLPFPRDRGPCTLAQMAMRSALARVVDSTSELVSVEQTLLGPLQQERSFPIHLKDSVEFRNICSHLALQIEGQQFDRDLNAAHQCLKTIVKKLIQSLANFPSDAHMVACASLRQILQNLPDI

SEQ ID NO: 11712 - protein, 170 aa, Homo sapiens
MAVTGWLESLRTAQKTALLQDGRRKVHYLFPDGKEMAEEYDEKTSELLVRKWRVKSALGAMGQWQLEVGDPAPLGAGNLGPELIKESNANPIFMRKDTKMSFQWRIRNLPYPKDVYSVSVDQKERCIIVRTTNKKRTGWRLLWTPLAMRCAGVHGTPSEIDTSYLWMTPC

SEQ ID NO: 11713 - protein, 170 aa, Homo sapiens; identical to SEQ ID NO: 11712

SEQ ID NO: 11714 - protein, 117 aa, Homo sapiens
MAEEYDEKTSELLVRKWRVKSALGAMGQWQLEVGDPAPLGAGNLGPELIKESNANPIFMRKDTKMSFQWRIRNLPYPKDVYSVSVDQKERCIIVRTTNKNTRSQRRLWWPSLSYRRN

SEQ ID NO: 11715 - protein, 203 aa, Homo sapiens
MAVTGWLESLRTAQKTALLQDGRRKVHYLFPDGKEMAEEYDEKTSELLVRKWRVKSALGAMGQWQLEVGDPAPLGAGNLGPELIKESNANPIFMRKDTKMSFQWRIRNLPYPKDVYSVSVDQKERCIIVRTTNKKYYKKFSIPDLDRHQLPLDDALLSFAHANCTLIISYQKPKEVVVAESELQKELKKVKTAHSNDGDCKTQ

SEQ ID NO: 11716 - protein, 246 aa, Homo sapiens [sequence omitted]

SEQ ID NO: 11717 - protein, 116 aa, Homo sapiens
AEEYDEKTSELLVRKWRVKSALGAMGQWQLEVGDPAPLGAGNLGPELIKESNANPIFMRKDTKMSFQWRIRNLPYPKDVYSVSVDQKERCIIVRTTNKNTRSQRRLWWPSLSYRRN

SEQ ID NO: 11718 - protein, 1009 aa, Homo sapiens
MDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDPLSVLKQVKKLEQALKDGSAGLDPQLPGTCYSPHCPPDKAEAGSTLPENLGGGSGSEVSQRVHPSDLEGREPTPELVEDRKGSCRRPWDRSLENVYRGSEGSPTKPFINPLPKPRRTFKHAGEGDKDGKPGIGFRKEKRNLPPLPSLPPPPLPSSPPPSSVNRRLWTGRQKSSADHRKSYEFEDLLQSSSESSRVDWYAQTKLGLTRTLSEENVYEDILDPPMKENPYEDIELHGRCLGKKCVLNFPASPTSSIPDTLTKQSLSKPAFFRQNSERRNFKLLDTRKLSRDGTGSPSKISPPSTPSSPDDIFFNLGDPQNGRKKRKIPKLVLRINAIYEVRRGKKRVKRLSQSMESNSGKVTDENSESDSDTEEKLKAHSQRLVNVKSRLKQAPRYPSLARELIEYQERQLFEYFVVVSLHKKQAGAAYVPELTQQFPLKLERSFKFMREAEDQLKAIPQFCFPDAKDWVPVQQFTSETFSFVLTGEDGSRRFGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLSILSKCCHAMVALIYPFAWQHTYIPVLPPAMVDIVCSPTPFLIGLLSSSLPLLRELPLEEVLVVDLVNSRFLRQMDDEDSILPRKLQVALEHILEQRNELACEQDEGPLDGRHGPESSPLNEVVSEAFVRFFVEIVGHYSLFLTSGEREERTLQREAFRKAVSSKSLRHFLEVFMETQMFRGFIQERELRRQDAKGLFEVRAQEYLETLPSGEHSGVNKFLKGLGNKMKFLHKK

SEQ ID NO: 11719 - protein, 79 aa, Homo sapiens
MDMFSLDMIISDPAAEASRAGKKQLRGVQNPCPSARARPRHKSLNIKDKISEWEGKKEVPTPAPSRRADGQEDYLPSST

SEQ ID NO: 11720 - protein, 90 aa, Homo sapiens
MDMFSLDMIISDPAAEASRAGKKQLRGVQNPCPSARARPRHKSLNIKDKISEWEGKKEVPTPAPSRRADGQEDYLPSSTVERRSSDGVRT

SEQ ID NO: 11721 - protein, 158 aa, Homo sapiens
MDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDPLS

SEQ ID NO: 11722 - protein, 795 aa, Homo sapiens
MDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDPLSVLKQVKKLEQALKDGSAGLDPQLPGTCYSPHCPPDKAEAGSTLPENLGGGSGSEVSQRVHPSDLEGREPTPELVEDRKGSCRRPWDRSLENVYRGSEGSPTKPFINPLPKPRRTFKHAGEGDKDGKPGIGFRKEKRNLPPLPSLPPPPLPSSPPPSSVNRRLWTGRQKSSADHRKSYEFEDLLQSSSESSRVDWYAQTKLGLTRTLSEENVYEDILDPPMKENPYEDIELHGRCLGKKCVLNFPASPTSSIPDTLTKQSLSKPAFFRQNSERRNFKLLDTRKLSRDGTGSPSKISPPSTPSSPDDIFFNLGDPQNGRKKRKIPKLVLRINAIYEVRRGKKRVKRLSQSMESNSGKVTDENSESDSDTEEKLKAHSQRLVNVKSRLKQAPRYPSLARELIEYQERQLFEYFVVVSLHKKQAGAAYVPELTQQFPLKLERSFKFMREAEDQLKAIPQFCFPDAKDWVPVQQFTSETFSFVLTGEDGSRRFGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLRYPPWLLLLKRLNDSRSWTL

SEQ ID NO: 11723 - protein, 1009 aa, Homo sapiens; identical to SEQ ID NO: 11718

SEQ ID NO: 11724 - protein, 1009 aa, Homo sapiens; identical to SEQ ID NO: 11718

SEQ ID NO: 11725 - protein, 928 aa, Homo sapiens
MDVGFSRTTVQTLSRSHCKNIKQKISQWEGRANGISNPEKWCPKDFGVRYNCHQEIRLKKNPIAERKSKNLDVTSRENVGLDINENTKSHDQSENENKKHEYDDTHFFKNESESNWVCSRVKEIESCKEDVLDPETSLPPGNFYTSQILWKKIEALPPDKLLNLALEHCDSSEKELNFRVLDSSYGITKSLENIYSEPEGQECGPSINPLPKPRRTFRYLSESGVTPYKERNCDKKYCENNSCAQSSLASSQEPEPKKYGGKIRGRSKRKSFEFEDIQHFRNRNSQTIREELGRNSGSALYYTQSEDNIYEDIIYPTKENPYEDIPVQPLPMWRSPSAWKLPPAKSAFKAPKLPPKPQFLHRKTMEVKNSQAYLRSKLTKDTTLPVTLTEWKLFRAGEVANTKRKNLPRLVLKIDDIFESKRGKKKVKLHSYTGKELPPTKGETSGNESDAEYLPKNRHKRLAQLQPSSKRNPHYQTLERDLIELQEQQLFELFVVVSLQKKPSGISYIPQVIQQFPGKDDHGYKQSKDMEERLKVIPKFCFPDSKDWMPTSELKSETFSFVLTGEDGSRWFGYCKKLLPVGKGKRLPEVYCMVSRLGCFNLFSKILDEVEKRREMSPALVYPFMRSVMEAPFPAPGRTITVKSYLPGAGDESIELCRPLDSRLEHVDFKCLFKCLSVCHLIRVCASLLLERRVIFVANSLSTLSKCGHAVVATLYPFTWQHTYIPVLPASMIDIVCSPTPFLIGILSCSLPQLQDLPIEEVLIVDLCADKFLQEVSDEDEILPPKLQAALMQILEERNEILTQEQNFSQDVTLNSLVSEAFVRFFVELVGHYSLNMTVTERGERVFQREPFRKSHTSRSVRHFLDLFMETQMFAGFIQDRELRKSGVKGLFEIRAIQYLETIPESEPSGMNRILRSLGSKMKFLQKK

SEQ ID NO: 11726 - protein, 928 aa, Homo sapiens; identical to SEQ ID NO: 11725

SEQ ID NO: 11727 - protein, 871 aa, Homo sapiens
MDVGFSRTTVQTLSRSHCKNIKQKISQWEGRANGISNPEKWCPKDFGVRYNCHQEIRLKKNPIAERKSKNLDVTSRENVGLDINENTKSHDQSENENKKHEYDDTHFFKNESESNWVCSRVKEIESCKEDVLDPETSLPPGNFYTSQILWKKIEALPPDKLLNLALEHCDSSEKELNFRVLDSSYGITKSLENIYSEPEGQECGPSINPLPKPRRTFRYLSESGVTPYKERNCDKKYCENNSCAQSSLASSQEPEPKKYGGKIRGRSKRKSFEFEDIQHFRNRNSQTIREELGRNSGSALYYTQSEDNIYEDIIYPTKENPYEDIPVQPLPMWRSPSAWKLPPAKSAFKAPKLVLKIDDIFESKRGKKKVKLHSYTGKELPPTKGETSGNESDAEYLPKNRHKRLAQLQPSSKRNPHYQTLERDLIELQEQQLFELFVVVSLQKKPSGISYIPQVIQQFPGKDDHGYKQSKDMEERLKVIPKFCFPDSKDWMPTSELKSETFSFVLTGEDGSRWFGYCKKLLPVGKGKRLPEVYCMVSRLGCFNLFSKILDEVEKRREMSPALVYPFMRSVMEAPFPAPGRTITVKSYLPGAGDESIELCRPLDSRLEHVDFKCLFKCLSVCHLIRVCASLLLERRVIFVANSLSTLSKCGHAVVATLYPFTWQHTYIPVLPASMIDIVCSPTPFLIGILSCSLPQLQDLPIEEVLIVDLCADKFLQEVSDEDEILPPKLQAALMQILEERNEILTQEQNFSQDVTLNSLVSEAFVRFFVELVGHYSLNMTVTERGERVFQREPFRKSHTSRSVRHFLDLFMETQMFAGFIQDRELRKSGVKGLFEIRAIQYLETIPESEPSGMNRILRSLGSKMKFLQKK

SEQ ID NO: 11728 - protein, 816 aa, Homo sapiens
MDVGFSRTTVQTLSRSHCKNIKQKISQWEGRANGISNPEKWCPKDFGVRYNCHQEIRLKKNPIAERKSKNLDVTSRENVGLDINENTKSHDQSENENKKHEYDDTHFFKNESESNWVCSRVKEIESCKEDVLDPETSLPPGNFYTSQILWKKIEALPPDKLLNLALEHCDSSEKELNFRVLDSSYGITKSLENIYSEPEGQECGPSINPLPKPRRTFRYLSESGVTPYKERNCDKKYCENNSCAQSSLASSQEPEPKKYGGKIRGRSKRKSFEFEDIQHFRNRNSQTIREELGRNSGSALYYTQSEDNIYEDIIYPTKENPYEDIPVQPLPMWRSPSAWKLPPAKSAFKAPKLPPKPQFLHRKTMEVKNSQAYLRSKLTKDTTLPVTLTEWKLFRAGEVANTKRKNLPRLVLKIDDIFESKRGKKKVKLHSYTGKELPPTKGETSGNESDAEYLPKNRHKRLAQLQPSSKRNPHYQTLERDLIELQEQQLFELFVVVSLQKKPSGISYIPQVIQQFPGKDDHGYKQSKDMEERLKVIPKFCFPDSKDWMPTSELKSETFSFVLTGEDGSRWFGYCKKLLPVGKGKRLPEVYCMVSRLGCFNLFSKILDEVEKRREMSPALVYPFMRSVMEAPFPAPGRTITLQDLPIEEVLIVDLCADKFLQEVSDEDEILPPKLQAALMQILEERNEILTQEQNFSQDVTLNSLVSEAFVRFFVELVGHYSLNMTVTERGERVFQREPFRKSHTSRSVRHFLDLFMETQMFAGFIQDRELRKSGVKGLFEIRAIQYLETIPESEPSGMNRILRSLGYKMKFLQKK

SEQ ID NO: 11729 - protein, 471 aa, Homo sapiens
MEGQVVGRVFRLFQRRLLQLRAGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 11730 - protein, 468 aa, Homo sapiens
MDGLGRRLRASLRLKRGHGGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 11731 - protein, 1198 aa, Homo sapiens
MRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 11732 - protein, 1146 aa, Homo sapiens
MRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 11733 - protein, 1496 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 11734 - protein, 333 aa, Homo sapiens
MVPGEEPARELMAVLLTPRFRRLVSQNELPGPGLNGPSSRNRRDGFCRKRRTGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEGVSFYTAITSDKTDVWKEQTLLCLLQLIHLPFLDNILEPPVKTQNLQLNKEEDLVITNTCLDRELIPSLCLPEIDNWLNAAIECLEYFPDQLIVTVSQQLMQNRNEETRLNSQKKILFDVIAKYYAQERDCLLTDEYFDIHSGIIELLENEKRAEALEATQLYLRLL

SEQ ID NO: 11735 - protein, 294 aa, Homo sapiens
MVPGEEPARELMAVLLTPRFRRLVSQNELPGPGLNGPSSRNRRDGFCRKRRTGCSGPFQATQLWDGIIHSLQAQVEIKRRRHHLQTYKDCFTGSDAVDVVLSHLMQNTCLSSNDISCLKGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEDVWKEQTLLCLLQLIHLPFLDNILEPPVKTQNLQLNKEEDLVITNTCLDRELIPSLCLPEK

SEQ ID NO: 11736 - protein, 387 aa, Homo sapiens
MVPGEEPARELMAVLLTPRFRRLVSQNELPGPGLNGPSSRNRRDGFCRKRRTGCSGPFQATQLWDGIIHSLQAQVEIKRRRHHLQTYKDCFTGSDAVDVVLSHLMQNTCLSSNDISCLKGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEDVWKEQTLLCLLQLIHLPFLDNILEPPVKTQNLQLNKEEDLVITNTCLDRELIPSLCLPEIDNWLNAAIECLEYFPDQLIVTVSQQLMQNRNEETRLNSQKKILFDVIAKYYAQERDCLLTDEYFDIHSGIIELLENEKRAEALEATQLYLRLL

SEQ ID NO: 11737 - protein, 102 aa, Homo sapiens
MADFLKGLPVYNKSNFSRFHADSVCKASNRRPSVYLPTREYPSEQIIVTEKTNILLRYLHQQWDKKNAAKKRDQEQVELEGESSAPPRKVARTDSPDMHEDT

SEQ ID NO: 11738 - protein, 382 aa, Homo sapiens
MMFPGLLAPPAGYPSLLRPTPTLTLPQSLQSAFSGHSSFLVEDLIRISRPPAYLPRSVPTASMSPPRQGAPTALTDTGASDLGSPGPGSRRGGSPPTAFSPASETTFLKFGVNAILSSGPRTETSPALLQSVPPKTFAFPYFEGSFQPFIRSSYFPASSSVVPIPGTFSWPLAARGKPRRGMLRRAVFSDVQRKALEKMFQKQKYISKPDRKKLAAKLGLKDSQDTARRTEPAPDSTPRPRASPGAPDLTSASPFFSPAGTFQVKIWFQNRRMKWRNSKERELLSSGGCREQTLPTKLNPHPDLSDVGQKGPGNEEEEEGPGSPSHRLAYHASSDPQHLRDPRLPGPLPPSPAHSSSPGKPSDFSDSEEEEEGEEQEEITVS

SEQ ID NO: 11739 - protein, 343 aa, Homo sapiens
MMFPGLLAPPAGYPSLLRPTPTLTLPQSLQSAFSGHSSFLVEDLIRISRPPAYLPRSVPTASMSPPRQGAPTALTDTGASDLGSPGPGSRRGGSPPTAFSPASETTFLKFGVNAILSSGPRTETSPALLQSVPPKTFAFPYFEGSFQPFIRSSYFPASSSVVPIPGTFSWPLAARGKPRRGMLRRAVFSDVQRKALEKMFQKQKYISKPDRKKLAAKLGLKDSQVKIWFQNRRMKWRNSKERELLSSGGCREQTLPTKLNPHPDLSDVGQKGPGNEEEEEGPGSPSHRLAYHASSDPQHLRDPRLPGPLPPSPAHSSSPGKPSDFSDSEEEEEGEEQEEITVS

SEQ ID NO: 11740 - protein, 95 aa, Homo sapiens
MLGARVAAHLDALGPLVPYVPPPLLPSMFYVGLFFVNVLILYYAFLMEYIVLNVGLVFLPEDMDQALVDLGVLSDPGSGLYDADSELDVFDAYLE

SEQ ID NO: 11741 - protein, 1271 aa, Homo sapiens
MDRGAAAAQGTAPPQDGEQPAESPEPPPPWPPPPPPPAPPPAPPLLSEASPEPIPEPCPELAPGPCPEATSESATELYTEPTPEPATEPASEPAPEPATEPAPEPATEPAPEPAPEPATESAPEPTPEPALESVPEPAPELTPEVAPELAPEPTPEPVTELAPEFCPEAAPEFRPSPAPCLLQCPVDTRERGLKTSPSPSPSPSPRTPMSWSRIKKILKEGPMLKNCNSFKRWKLRYFLVQGQKLYFAHHPAFAHFETIDLSQATVAESSCRNLCHSFCVITPQRKITLAAPNRKDMEEWINIIKTIQQGEIYKIPAAENNPFLVGMHCWYSSYSHRTQHCNVCRESIPALSRDAIICEVCKVKSHRLCALRASKDCKWNTLSITDDLLLPADEVNMPHQWVEGNMPVSSQCAVCHESCGSYQRLQDFRCLWCNSTVHDDCRRRFSKECCFRSHRSSVIPPTALSDPKGDGQLVVSSDFWNLDWSSACSCPLLIFINSKSGDHQGIVFLRKFKQYLNPSQVFDLLKGGPEAGLSMFKNFARFRILVCGGDGSVSWVLSLIDAFGLHEKCQLAVIPLGTGNDLARVLGWGAFWNKSKSPLDILNRVEQASVRILDRWSVMIRETPRQTPLLKGQVEMDVPRFEAAAIQHLESAATELNKILKAKYPTEMIIATRFLCSAVEDFVVDIVKAWGQIKQNNTAIVSVILKSDLMYDRLSVLIDVLAEEAAATSAEKSATEYADSSKADRKPFIPQIDHIAKCKLELATKAQSLQKSLKLIIFQVEQALDEESRQTISVKNFSSTFFLEDDPEDINQTSPRRRSRRGTLSSISSLKSEDLDNLNLDHLHFTPESIRFKEKCVMNNYFGIGLDAKISLDFNTRRDEHPGQYNSRLKNKMWYGLLGTKELLQRSYRKLEERVHLECDGETISLPNLQGIVVLNITSYAGGINFWGSNTATTEYEAPAIDDGKLEVVAIFGSVQMAMSRIINLHHHRIAQCHEVMITIDGEEGIPVQVDGEAWIQRPGLIKIRYKNAAQMLTRDRDFENSMKMWEYKHTEIQAAPQPQLDFQDSQESLSDEEYAQMQHLARLAENLISKLNDLSKIHQHVSVLMGSVNASANILNDIFYGQDSGNEMGAASCIPIETLSRNDAVDVTFSLKGLYDDTTAFLDEKLLRSAEDETALQSALDAMNKEFKKLSEIDWMNPIFVPEEKSSDTDSRSLRLKIKFPKLGKKKVEEERKPKSGQSVQSFIGNLWHRRHREDEAEGDDPLTPSRSQL

SEQ ID NO: 11742 - protein, 849 aa, Homo sapiens
MSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSIFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHGNKPYL

SEQ ID NO: 11743 - protein, 1193 aa, Homo sapiens
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 11744 - protein, 1182 aa, Homo sapiens
MERHQPRLHHPAQGSAAGTPYPSSASLRGCRESKMPRRKGPQHPPPPSGPEEPGEKRPKFLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSIFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 11745 - protein, 1123 aa, Homo sapiens
MERHQPRLHHPAQGSAAGTPYPSSASLRGCRESKMPRRKGPQHPPPPSGPEEPGEKRPKFEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSIFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 11746 - protein, 1193 aa, Homo sapiens
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSIFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 11747 - protein, 1147 aa, Homo sapiens
MERHQPRLHHPAQGSAAGTPYPSSASLRGCRESKMPRRKGPQHPPPPSGPEEPGEKRPKFLDKFASIRIPGSKKERPPLPNLKTAFASSDCSAAPLEMMENFPKPLSENELLELFEKMMGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSIFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 11748 - protein, 1016 aa, Homo sapiens
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSIFVISAKEQYETLSKLHENMEKLYQSIIGYYAIDVKKVSVEDFLTDLNNFRTTFMKAIKFQI

SEQ ID NO: 11749 - protein, 1112 aa, Homo sapiens
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHGNKPYL

SEQ ID NO: 11750 - protein, 621 aa, Homo sapiens
MCSGWSSSVIWRHTQFAVERCGFCGSSGPGAPLEPSTLGSKHLPWEAVSAGFADRNRNMDGAMWLSLCPDNEDLLWRKKHKLLQARGKGDLALQRRADAKLWKNYQLQRLAEELRRGYQEAQHLHVGGLDRLQSARLLGWGGGRARENEPDSQGPIQRRSARPPRAKEKHRAALSEERSCREELGQQHPRHSRPRKTAASPEKPQTTKATGRMNSHLAPPEKRKGRPEPSTKSGGGRCAIHPRRSKGADLERSNPLVAAVGEIGLVEEKEKGTARAGRRQLGKGAVCFVPALTSRSQGQSLEGKLRDLGQLWPADSSCRREAVSPASQCTLREKNKWQKELELAFEELFNINRKLKKHLCLYLALKPRMDQRPGEGHAFSEMQECGAGTPRGKKMADPEMLPAGEPRSPAEEEAQQAASKTDLKTFMGKAQNQKYQGTVKPTFRNGSQTLSPEAGIFINKEDSLLYSTESGQETPKLGTLAEGSLQLHLQDQADRVGSTASRQRQKAEMEQRRQKQLESLEQMEHPDMSLEIHYKAELEKERREQRRARLAHLKSSSTRAQERERGSELSTTSPSGTSLADDDRHSQMIRDQQQQILQQNRLHKQFLEEARKCLREFQNIC

SEQ ID NO: 11751 - protein, 512 aa, Homo sapiens
MAILSLRAPGPWQAMQVWADRTLLTPHTGVTSQVLGVAAAVMTPLPGGHAAGRTREARWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 11752 - protein, 197 aa, Homo sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGGPRPRRGVRNERDQSSCLRWAHIQM

SEQ ID NO: 11753 - protein, 451 aa, Homo sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 11754 - protein, 441 aa, Homo sapiens
MEYDEKLARFRQAHLNPFNKQSGPRQHEQGPGEEVPDVTPEEALPELPPGEPEFRCPERVMDLGLSEDHFSRPVLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 11755 - protein, 334 aa, Homo sapiens
MALRWGIVSVGLISSDFTAVLQTLPRSEHQVVAVAARDLSRAKEFAQKHDIPKAYGSYEELAKDPSVEVAYIGTQHPQHKAAVMLCLAAGKAVLCEKPTGVNAAEVREMVAEARSRALFLMEAIWTRFFPASEALRSVLAQGTLGDLRVARAEFGKNLIHVPRAVDRAQAGGALLDIGIYCVQFTSMVFGGQKPEKISVVGRRHETGVDDTVTVLLQYPGEVHGSFTCSITVQLSNTASVSGTKGMVQLLNPCWCPTELVVKGEHKEFPLPPVPKDCNFDNGAGMSYEAKHVWECLRKGMKESPVIPLSESELLADILEEVRKAIGVTFPQDKR

SEQ ID NO: 11756 - protein, 473 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHPCPLSYVRAHLFKLWHHTLQVHQELREELAKVKTLEGIAAVSQELKLRCQEEISRQEGAKPTGDLPFHWICQPYIRPGPREGSKEKAGARSKRALEEEEGGTEVLSKNKQKKQLRNPHKTFDPSLKPKYAKCDQCGNPKGNRCVFSLCRGCCKKRASKETADCPGHGLLFKTKLEKSLAWKEAQPELQEPQPAAPGTPGGFSEVMGSALA

SEQ ID NO: 11757 - protein, 473 aa, Homo sapiens; identical to SEQ ID NO: 11756

SEQ ID NO: 11758 - protein, 297 aa, Homo sapiens
PSFAGPRETLPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHPCPLSYVRAHLFKLWHHTLQVHQELREELAKVKTLEGIAAVSQELKLRCQEISRQEGAKPTGDLPFHWICQPYIRPGPREGSKEKAGARSKRALEEEEGGTEVLSKNKQKKQLRNPHKTFDPSLKPKYAKCDQCGNPKMCVQPVPRLLQEASLQRDCRLPRSRIAF

SEQ ID NO: 11759 - protein, 336 aa, Homo sapiens
MIAKRVLLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVRAHLFKLWHHTLQVHQELREELAKVKTLEGIAAVSQELKLRCQEEISRQEGAKPTGDLPFHWICQPYIRPGPREGSKEKAGARSKRALEEEEGGTEVLSKNKQKKQLRNPHKTFDPSLKPKYAKCDQCGNPKGNRCVFSLCRGCCKKRASKETADCPGHGLLFKTKLEKSLAWKEAQPELQEPQPAAPGTPGGFSEVMGSALA

SEQ ID NO: 11760 - protein, 650 aa, Homo sapiens
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 11761 - protein, 408 aa, Homo sapiens
MAEGTAEAPLENGGGGDSGAGALERGVAPIKRQYLTTKEQFHQFLEAKGQEKTCRETELDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 11762 - protein, 317 aa, Homo sapiens
MKSDCMQTTICQERKKDPIEMFHSGQLVKVCAPMVRYSKLAFRTLVRKYSCDLCYTPMIVAADFVKSIKARDSEFTTNQGDCPLIVQFAANDARLLSDAARIVCPYANGIDINCGCPQRWAMAEGYGACLINKPELVQDMVKQVRNQVETPGFSVSIKIRIHDDLKRTVDLCQKAEATGVSWITVHGRTAEERHQPVHYDSIKIIKENMSIPVIANGDIRSLKEAENVWRITGTDGVMVARGLLANPAMFAGYEETPLKCIWDWVDIALELGTPYMCFHQHLMYMMEKITSRQEKRVFNALSSTSAIIDYLTDHYGI

SEQ ID NO: 11763 - protein, 196 aa, Homo sapiens
MAEGYGACLINKPELVQDMVKQVRNQVETPGFSVSIKIRIHDDLKRTVDLCQKAEATGVSWITVHGRTAEERHQPVHYDSIKIIKENMSIPVIANGDIRSLKEAENVWRITGTDGVMVARGLLANPAMFAGYEETPLKCIWDWVDIALELGTPYMCFHQHLMYMMEKITSRQEKRVFNALSSTSAIIDYLTDHYGI

SEQ ID NO: 11764 - protein, 1222 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 11765 - protein, 989 aa, Homo sapiens
MKGLGDSRPRHLSDSLDPPHEPLFAGTDRNPYLLSPTEAFAREARFPGQNTLPGDGLFPLNNQLPPPSSTFPRIHYNSHFEVPEESPFPSHAQATKINRLPANLLDQFEKQLPIHRDGFSTLQFPRGEAKARGESPGRIRHLVHSVQRLFFTKAPSLEGTAGKVGGNGSKKGGMEDGKGRRAKSKERAKAGEPKRRSRSNISGWWSSDDNLDGEAGAFRSSGPASGLMTLGRQAERSQPRYFMHAYNTISGHMLKTTKNNTTELTAPPPPPAPPATCPSLGVGTDTNYVKRGSWSTLTLSHAHEVCQKTSATLDKSLLKSKSCHQGLAYHYLQVPGGGGEWSTTLLSPRETDAAAEGPIPCRRMRSGSYIKAMGDEDSDESGGSPKPSPKTAARRQSYLRATQQSLGEQSNPRRSLDRLDSVDMLLPSKCPSWEEDYTPVSDSLNDSSCISQIFGQASLIPQLFGHEQQVREAELSDQYEAACESACSEAESTAAETLDLPLPSYFRSRSHSYLRAIQAGCSQEEDSVSLQSLSPPPSTGSLSNSRTLPSSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQERTRRNGSHLSEDNGPKAIDVMAPSSESSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 11766 - protein, 992 aa, Homo sapiens
MKGLGDSRPRHLSDSLDPPHEPLFAGTDRNPYLLSPTEAFAREARFPGQNTLPGDGLFPLNNQLPPPSSTFPRIHYNSHFEVPEESPFPSHAQATKINRLPANLLDQFEKQLPIHRDGFSTLQFPRGEAKARGESPGRIRHLVHSVQRLFFTKAPSLEGTAGKVGGNGSKKGGMEDGKGRRAKSKERAKAGEPKRRSRSNISGWWSSDDNLDGEAGAFRSSGPASGLMTLGRQAERSQPRYFMHAYNTISGHMLKTTKNNTTELTAPPPPPAPPATCPSLGVGTDTNYVKRGSWSTLTLSHAHEVCQKTSATLDKSLLKSKSCHQGLAYHYLQVPGGGGEWSTTLLSPRETDAAAEGPIPCRRMRSGSYIKAMGDEDSDESGGSPKPSPKTAARRQSYLRATQQSLGEQSNPRRSLDRLDSVDMLLPSKCPSWEEDYTPVSDSLNDSSCISQIFGQASLIPQLFGHEQQVREAELSDQYEAACESACSEAESTAAETLDLPLPSYFRSRSHSYLRAIQAGCSQEEDSVSLQSLSPPPSTGSLSNSRTLPSSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 11767 - protein, 992 aa, Homo sapiens; identical to SEQ ID NO: 11766

SEQ ID NO: 11768 - protein, 453 aa, Homo sapiens
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 11769 - protein, 992 aa, Homo sapiens; identical to SEQ ID NO: 11766

SEQ ID NO: 11770 - protein, 989 aa, Homo sapiens; identical to SEQ ID NO: 11765

SEQ ID NO: 11771 - protein, 989 aa, Homo sapiens; identical to SEQ ID NO: 11765

SEQ ID NO: 11772 - protein, 191 aa, Homo sapiens
MPGSEDLRKGKDQMHSHRKRTMFTKKQLEDLNILFNENPYPNPSLQKEMASKIDIHPTVLQVWFKNHRAKLKKAKCKHIHQKQETPQPPIPEGGVSTSVGLRNADTLPRLPNAAHPIGLVYTGHRVPSFQLILYPNLKVPANDFIGHRIVHFGCCRDPNIYCLYPILESQVCAPSFHSGSPACSSNQSRER

SEQ ID NO: 11773 - protein, 683 aa, Homo sapiens
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 11774 - protein, 127 aa, Homo sapiens
MAAPPKAPIRVRNLTIRAGALTGKENNMLQPETHIFTAPEEVPKVSDQALVSAHSEWQRKLEAAEALLTLRNSAQAPPDSISLHQPCNPPAPAGDKGFQPPSPSLRPRPASSISLPIGHLGCISLLS

SEQ ID NO: 11775 - protein, 192 aa, Homo sapiens
MAAPPKAPIRVRNLTIRAGALTGKENNMLQPETHIFTAPEEGSSQGALLLGQAPEPLSLPCTPVTLEQQLVSPSGDPHRAPALPSICSTLILQPCATLDPLLLQPQVPKVSDQALVSAHSEWQRKLEAAEALLTLRNSAQAPPDSISLHQPCNPPAPAGDKGFQPPSPSLRPRPASSISLPIGHLGCISLLS

SEQ ID NO: 11776 - protein, 127 aa, Homo sapiens; identical to SEQ ID NO: 11774

SEQ ID NO: 11777 - protein, 192 aa, Homo sapiens; identical to SEQ ID NO: 11775

SEQ ID NO: 11778 - protein, 192 aa, Homo sapiens; identical to SEQ ID NO: 11775

SEQ ID NO: 11779 - protein, 127 aa, Homo sapiens; identical to SEQ ID NO: 11774

SEQ ID NO: 11780 - protein, 64 aa, Homo sapiens
MAAPPKAPIRVRNLTIRAGALTGKENNMLQPETHIFTAPEEGSSQGALLLGQAPEPLSLPCTPV

SEQ ID NO: 11781 - protein, 101 aa, Homo sapiens
MAAPPKAPIRVRNLTIRAGALTGKENNMLQPETHIFTAPEEGSSQGALLLGQAPEPLSLPCTPVTLEQQLVSPSGDPHRAPALPSICSTLILQPCATLDPL

SEQ ID NO: 11782 - protein, 192 aa, Homo sapiens; identical to SEQ ID NO: 11775

SEQ ID NO: 11783 - protein, 396 aa, Homo sapiens
MLITVYCVRRDLSEVTFSLQVSPDFELRNFKVLCEAESRVPVEEIQIIHMERLLIEDHCSLGSYGLKDGDIVVLLQKDNVGPRAPGRAPNQPRVDFSGIAVPGTSSSRPQHPGQQQQRTPAAQRSQGLASGEKVAGLQGLGSPALIRSMLLSNPHDLSLLKERNPPLAEALLSGSLETFSQVLMEQQREKALREQERLRLYTADPLDREAQAKIEEEIRQQNIEENMNIAIEEAPESFGQVTMLYINCKVNGHPLKAFVDSGAQMTIMSQACAERCNIMRLVDRRWAGVAKGVGTQRIIGRVHLAQIQIEGDFLQCSFSILEDQPMDMLLGLDMLRRHQCSIDLKKNVLVIGTTGTQTYFLPEGELPLCSRMVSGQDESSDKEITHSVMDSGRKEH

SEQ ID NO: 11784 - protein, 399 aa, Homo sapiens
MLLTVYCVRRDLSEVTFSLQVDADFELHNFRALCELESGIPAAESQIVYAERPLTDNHRSLASYGLKDGDVVILRQKENADPRPPVQFPNLPRIDFSSIAVPGTSSPRQRQPPGTQQSHSSPGEITSSPQGLDNPALLRDMLLANPHELSLLKERNPPLAEALLSGDLEKFSRVLVEQQQDRARREQERIRLFSADPFDLEAQAKIEEDIRQQNIEENMTIAMEEAPESFGQVVMLYINCKVNGHPVKAFVDSGAQMTIMSQACAERCNIMRLVDRRWAGIAKGVGTQKIIGRVHLAQVQIEGDFLPCSFSILEEQPMDMLLGLDMLKRHQCSIDLKKNVLVIGTTGSQTTFLPEGELPECARLAYGAGREDVRPEEIADQELAEALQKSAEDAERQKP

SEQ ID NO: 11785 - protein, 388 aa, Homo sapiens
MNTMYVMMAQILRSHLIKATVIPNRVKMLPYFGIIRNRMMSTHKSKKKIREYYRLLNVEEGCSADEVRESFHKLAKQYHPDSGSNTADSATFIRIEKAYRKVLSHVIEQTNASQSKGEEEEDVEKFKYKTPQHRHYLSFEGIGFGTPTQREKHYRQFRADRAAEQVMEYQKQKLQSQYFPDSVIVKNIRQSKQQKITQAIERLVEDLIQESMAKGDFDNLSGKGKPLKKFSDCSYIDPMTHNLNRILIDNGYQPEWILKQKEISDTIEQLREAILVSRKKLGNPMTPTEKKQWNHVCEQFQENIRKLNKRINDFNLIVPILTRQKVHFDAQKEIVRAQKIYETLIKTKEVTDRNPNNLDQGEGEKTPEIKKGFLNWMNLWKFIKIRSF

SEQ ID NO: 11786 - protein, 388 aa, Homo sapiens; identical to SEQ ID NO: 11785

SEQ ID NO: 11787 - protein, 397 aa, Homo sapiens
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 11788 - protein, 257 aa, Homo sapiens
MQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTSNGPVNNTHCWHLMCSSE

SEQ ID NO: 11789 - protein, 240 aa, Homo sapiens
MQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 11790 - protein, 397 aa, Homo sapiens
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 11791 - protein, 397 aa, Homo sapiens; identical to SEQ ID NO: 11790

SEQ ID NO: 11792 - protein, 426 aa, Homo sapiens
MARGGSQSWSSGESDGQPKEQTPEKPRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 11793 - protein, 370 aa, Homo sapiens
MWESLTLDSGQISALTRFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 11794 - protein, 316 aa, Homo sapiens
MGQDYYSVLGITRNSEDAQIKQAYRRLALKHHPLKSNEPSSAEIFRQIAEAYDVLSDPMKRGIYDKFGEEGLKGGIPLEFGSQTPWTTGYVFHGKPEKVFHEFFGGNNPFSEFFDAEGSEVDLNFGGLQGRGVKKQDPQVERDLYLSLEDLFFGCTKKIKISRRVLNEDGYSSTIKDKILTIDVKPGWRQGTRITFEKEGDQGPNIIPADIIFIVKEKLHPRFRRENDNLFFVNPIPLGKALTCCTVEVRTLDDRLLNIPINDIIHPKYFKKVPGEGMPLPEDPTKKGDLFIFFDIQFPTRLTPQKKQMLRQALLT

SEQ ID NO: 11795 - protein, 141 aa, Homo sapiens
METSRGRNLAKVTRPTSPCHLLASPAQGPNIIPADIIFIVKEKLHPRFRRENDNLFFVNPIPLGKALTCCTVEVRTLDDRLLNIPINDIIHPKYFKKVPGEGMPLPEDPTKKGDLFIFFDIQFPTRLTPQKKQMLRQALLT

SEQ ID NO: 11796 - protein, 141 aa, Homo sapiens; identical to SEQ ID NO: 11795

SEQ ID NO: 11797 - protein, 309 aa, Homo sapiens
MVDYYEVLGLQRYASPEDIKKAYHKVALKWHPDKNPENKEEAERKFKEVAEAYEVLSNDEKRDIYDKYGTEGLNGGGSHFDDECEYGFTFHKPDDVFKEIFHERDPFSFHFFEDSLEDLLNRPGSSYGNRNRDAGYFFSTASEYPIFEKFSSYDTGYTSQGSLGHEGLTSFSSLAFDNSGMDNYISVTTSDKIVNGRNINTKKIIESDQEREAEDNGELTFFLVNSVANEEGFAKECSWRTQSFNNYSPNSHSSKHVSQYTFVDNDEGGISWVTSNRDPPIFSAGVKEGGKRKKKKRKEVQKKSTKRNC

SEQ ID NO: 11798 - protein, 232 aa, Homo sapiens
MANYYEVLGVQASASPEDIKKAYRKLALRWHPDKNPDNKEEAEKKFKLVSEAYEVLSDSKKRSLYDRAGCDSWRAGGGASTPYHSPFDTGYTFRNPEDIFREFFGGLDPFSFEFWDSPFNSDRGGRGHGLRGAFSAGFGEFPAFMEAFSSFNMLGCSGGSHTTFSSTSFGGSSSGSSGFKSVMSSTEMINGHKVTTKRIVENGQERVEVEEDGQLKSVTVNGKEQLKWMDSK

SEQ ID NO: 11799 - protein, 232 aa, Homo sapiens; identical to SEQ ID NO: 11798

SEQ ID NO: 11800 - protein, 198 aa, Homo sapiens
MDAILNYRSEDTEDYYTLLGCDELSSVEQILAEFKVRALECHPDKHPENPKAVETFQKLQKAKEILTNEESRARYDHWRRSQMSMPFQQWEALNDSVKTSMHWVVRGKKDLMLEESDKTHTTKMENEECNEQRERKKEELASTAEKTEQKEPKPLEKSVSPQNSDSSGFADVNGWHLRFRWSKDAPSELLRKFRNYEI

SEQ ID NO: 11801 - protein, 107 aa, Homo sapiens
MDAILNYRSEDTEDYYTLLGCDELSSVEQILAEFKVRALECHPDKHPENPKAVETFQKLQKAKEILTNEESRARYDHWRRSQMSMPFQQWEALNDSVKTVGFSLGAT

SEQ ID NO: 11802 - protein, 304 aa, Homo sapiens
MAVTKELLQMDLYALLGIEEKAADKEVKKAYRQKALSCHPDKNPDNPRAAELFHQLSQALEVLTDAAARAAYDKVRKAKKQAAERTQKLDEKRKKVKLDLEARERQAQAQESEEEEESRSTRTLEQEIERLREEGSRQLEEQQRLIREQIRQERDQRLRGKAENTEGQGTPKLKLKWKCKKEDESKGGYSKDVLLRLLQKYGEVLNLVLSSKKPGTAVVEFATVKAAELAVQNEVGLVDNPLKISWLEGQPQDAVGRSHSGLSKGSVLSERDYESLVMMRMRQAAERQQLIARMQQEDQEGPPT

SEQ ID NO: 11803 - protein, 149 aa, Homo sapiens
MMAVEQMPKKDWYSILGADPSANISDLKQKYQKLILMYHPDKQSTDVPAGTVEECVQKFIEIDQAWKILGNEETKREYDLQRCEDDLRNVGPVDAQVYLEEMSWNEGDHSFYLSCRCGGKYSVSKDEAEEVSLISCDTCSLIIELLHYN

SEQ ID NO: 11804 - protein, 84 aa, Homo sapiens
MAVEQMPKKDWYSILGADPSANISDLKQKYQKLILMYHPDKQSTDVPAGTVEECVQKFIEIDQAWKILGNEETKREYDLQRCGS

SEQ ID NO: 11805 - protein, 388 aa, Homo sapiens; identical to SEQ ID NO: 11785

SEQ ID NO: 11806 - protein, 388 aa, Homo sapiens; identical to SEQ ID NO: 11785

SEQ ID NO: 11807 - protein, 388 aa, Homo sapiens; identical to SEQ ID NO: 11785

SEQ ID NO: 11808 - protein, 153 aa, Homo sapiens
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKVSQAAAELQQYCMQNACKDALLVGVPAGSNPFREPRSCALL

SEQ ID NO: 11809 - protein, 331 aa, Homo sapiens
MASNFNDIVKQGYVKIRSRKLGIFRRCWLVFKKASSKGPRRLEKFPDEKAAYFRNFHKVTELHNIKNITRLPRETKKHAVAIIFHDETSKTFACESELEAEEWCKHLCMECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARLQTSLTEPMTLSKSISLPRSAYWHHITRQNSVGEIYSLQGHGFGSSKMSRAQTFPSYAPEQSEEAQQPLSRSSSYGFSYSSSLIQ

SEQ ID NO: 11810 - protein, 204 aa, Homo sapiens
MAEDTYSHKMVKTNHRRCRTKFTEEQLKILINTFNQKPYPGYATKQKLALEINTEESRIQIWFQNRRARHGFQKRPEAETLESSQSQGQDQPGVEFQSREARRCRTTYSASQLHTLIKAFMKNPYPGIDSREELAKEIGVPESRVQIWFQNRRSRLLLQRKREPVASLEQEEQGKIPEGLQGAEDTQNGTNFTSDSHFSGARTW

SEQ ID NO: 11811 - protein, 752 aa, Homo sapiens
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPESPLEIPAYGGGSGSRPPTRQSQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 11812 - protein, 730 aa, Homo sapiens
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQAREFKNGFVGSKLKKKYKNSENQRSWNVNLRKFPESPLEIPAYGGGSGSRPPTRQSQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKVRKLRLREVKQPASSKGTKLAGRPLIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 11813 - protein, 638 aa, Homo sapiens
MLTLESFQRVHWKSQLMVEDQVLDHPPASPRQDTVPFTFKSFLFGHSMEIRPWKRKGRTLFRRLLFQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 11814 - protein, 551 aa, Homo sapiens
  MOD_RES (1)..(1): Any amino acid
XQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 11815 - protein, 585 aa, Homo sapiens
MLTLESFQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSEPRCAWQSLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 11816 - protein, 537 aa, Homo sapiens
MTINSFKSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQELGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 11817 - protein, 584 aa, Homo sapiens
MTINSFKSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSEPRCAWQSLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 11818 - protein, 349 aa, Homo sapiens
MAGGSPAAKRVVVYRNGDPFFPGSQLVVTQRRFPTMEAFLCEVTSAVQAPLAVRALYTPCHGHPVTNLADLKNRGQYVAAGFERFHKLHYLPHRGKDPGGKSCRLQGPPVTRHLCDGAIGRQLPAGAPSYIHVFRNGDLVSPPFSLKLSQAASQDWETVLKLLTEKVKLQSGAVCKLCTLEGLPLSAGKELVTGHYYVAVGEDEFKDLPYLELLVPSPSLPRGCWQPPGSKSRPHRQGAQGHRAQVTQPSPKEPDRIKPSAFYARPQQTIQPRSKLPTLSFPSGVIGVYGAPHRRKETAGALEVADDEDTQTEEPLDQRAAQIVEEALSLENQPGAGAAISASAPALPS

SEQ ID NO: 11819 - protein, 150 aa, Homo sapiens
LILEEQFPSGLIGPLFTMNGHLLGDSKDLQDNHFYVAVGLETFKYFPYWKSPRVPSEVQQRYANVEKNSQRKKKVDSKGKEPCKYDGIPPKTQDSVYYAKEEKKKTLAEPLVQRGAEGDVYKAPTPSKETQGALDVKEEHNVQLEVPVDQ

SEQ ID NO: 11820 - protein, 192 aa, Homo sapiens; identical to SEQ ID NO: 11775

SEQ ID NO: 11821 - protein, 177 aa, Homo sapiens
MESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGAPNLSRVEELDEPMFSDIALNIDQDL

SEQ ID NO: 11822 - protein, 177 aa, Homo sapiens; identical to SEQ ID NO: 11821

SEQ ID NO: 11823 - protein, 184 aa, Homo sapiens
MESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGAPNLSRVEELDEPMFSDVSISVFCEKTRFCFCF

SEQ ID NO: 11824 - protein, 80 aa, Homo sapiens
MESIYLQKHLGACLTQGLAEVARVRPVDPIEYLALWIYKYKENVTMEQLRQKEMAKLERERELALMEQEMMERLKAEELL

SEQ ID NO: 11825 - protein, 153 aa, Homo sapiens [sequence omitted]

SEQ ID NO: 11826 - protein, 177 aa, Homo sapiens
METNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGTSSLIPGMPQQVPPSESAGQIDQNFKMPQEINYKEAFQHEVAHEMPPGSKSPF

SEQ ID NO: 11827 - protein, 177 aa, Homo sapiens; identical to SEQ ID NO: 11826

SEQ ID NO: 11828 - protein, 191 aa, Homo sapiens
MILRPPQQCGTAARMETNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGTSSLIPGMPQQVPPSESAGQIDQNFKMPQEINYKEAFQHEVAHEMPPGSKSPF

SEQ ID NO: 11829 - protein, 177 aa, Homo sapiens; identical to SEQ ID NO: 11826

SEQ ID NO: 11830 - protein, 126 aa, Homo sapiens
METNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGTS

SEQ ID NO: 11831 - protein, 177 aa, Homo sapiens; identical to SEQ ID NO: 11826

SEQ ID NO: 11832 - protein, 304 aa, Homo sapiens
MSLNPPIFLKRSEENSSKFVETKQSQTTSIASEDPLQNLCLASQEVLQKAQQSGRSKCLKCGGSRMFYCYTCYVPVENVPIEQIPLVKLPLKIDIIKHPNETDGKSTAIHAKLLAPEFVNIYTYPCIPEYEEKDHEVALIFPGPQSISIKDISFHLQKRIQNNVRGKNDDPDKPSFKRKRTEEQEFCDLNDSKCKGTTLKKIIFIDSTWNQTNKIFTDERLQGLLQVELKTRKTCFWRHQKGKPDTFLSTIEAIYYFLVDYHTDILKEKYRGQYDNLLFFYSFMYQLIKNAKCSGDKETGKLTH

SEQ ID NO: 11833 - protein, 109 aa, Homo sapiens
MSLNPPIFLKRSEENSSKFVETKQSQTTSIASEDPLQNLCLASQEVLQKAQQSGRSKCLKCGGSRMFYCYTCYVPVENVPIEQIPLVKFSLYHLGQSMVSSASKITCIG

SEQ ID NO: 11834 - protein, 304 aa, Homo sapiens; identical to SEQ ID NO: 11832

SEQ ID NO: 11835 - protein, 217 aa, Homo sapiens
MLPLKIDIIKHPNETDGKSTAIHAKLLAPEFVNIYTYPCIPEYEEKDHEVALIFPGPQSISIKDISFHLQKRIQNNVRGKNDDPDKPSFKRKRTEEQEFCDLNDSKCKGTTLKKIIFIDSTWNQTNKIFTDERLQGLLQVELKTRKTCFWRHQKGKPDTFLSTIEAIYYFLVDYHTDILKEKYRGQYDNLLFFYSFMYQLIKNAKCSGDKETGKLTH

SEQ ID NO: 11836 - protein, 304 aa, Homo sapiens; identical to SEQ ID NO: 11832

SEQ ID NO: 11837 - protein, 94 aa, Homo sapiens
MSLNPPIFLKRSEENSSKFVETKQSQTTSIASEDPLQNLCLASQEVLQKAQQSGRSKCLKCGGSRMFYCYTCYVPVENVPIEQIPLVKLPLKID

SEQ ID NO: 11838 - protein, 298 aa, Homo sapiens
MESQKEARTLQEPVARPSGASSSQTPNDKERREGGAVPAAAALGAEADDDSADGLWELPVEPAERRPECTRCSRPQKVCLCPFLPAHPLHISTHLYIIQHPAEENKVLRTVPLLAACLPQDKCKVKIGRRFSEERDPELSTVCRKSGTLILYPGAEAANLEEFILDSPVYPSTIIIIDGTWSQAKDIFYKNSLFRHPKQVQLKTSISSQYVIRMQPTNRCLSTLECAAVALSILEKNNYIQETLLRPLQALCSFQLQHGAQIRLSKEHLLKNGLYPKPMPKNKRKLRKMELLMNSVKI

SEQ ID NO: 11839 - protein, 1158 aa, Homo sapiens
MATRKDTEEEQVVPSEEDEANVRAVQAHYLRSPSPSQYSMVSDAETESIFMEPIHLSSAIAAKQIINEELKPPGVRADAECPGMLESAEQLLVEDLYNRVREKMDDTSLYNTPCVLDLQRALVQDRQEAPWNEVDEVWPNVFIAEKSVAVNKGRLKRLGITHILNAAHGTGVYTGPEFYTGLEIQYLGVEVDDFPEVDISQHFRKASEFLDEALLTYRGKVLVSSEMGISRSAVLVVAYLMIFHNMAILEALMTVRKKRAIYPNEGFLKQLRELNEKLMEEREEDYGREGGSAEAEEGEGTGSMLGARVHALTVEEEDDSASHLSGSSLGKATQASKPLTLIDEEEEEKLYEQWKKGQGLLSDKVPQDGGGWRSASSGQGGEELEDEDVERIIQEWQSRNERYQAEGYRRWGREEEKEEESDAGSSVGRRRRTLSESSAWESVSSHDIWVLKQQLELNRPDHGRRRRADSMSSESTWDAWNERLLEIEKEASRRYHAKSKREEAADRSSEAGSRVREDDEDSVGSEASSFYNFCSRNKDKLTALERWKIKRIQFGFHKKDLGAGDSSGEPGAEEAVGEKNPSDVSLTAYQAWKLKHQKKVGSENKEEVVELSKGEDSALAKKRQRRLELLERSRQTLEESQSMASWEADSSTASGSIPLSAFWSADPSVSADGDTTSVLSTQSHRSHLSQAASNIAGCSTSNPTTPLPNLPVGPGDTISIASIQNWIANVVSETLAQKQNEMLLLSRSPSVASMKAVPAASCLGDDQVSMLSGHSSSSLGGCLLPQSQARPSSDMQSVLSCNTTLSSPAESCRSKVRGTSKPIFSLFADNVDLKELGRKEKEMQMELREKMSEYKMEKLASDNKRSSLFKKKKVKEDEDDGVGDGDEDTDSAIGSFRYSSRSNSQKPETDTCSSLAVCDHYASGSRVGKEMDSSINKWLSGLRTEEKPPFQSDWSGSSRGKYTRSSLLRETESKSSSYKFSKSQSEEQDTSSYHEANGNSVRSTSRFSSSSTREGREMHKFSRSTYNETSSSREESPEPYFFRRTPESSEREESPEPQRPNWARSRDWEDVEESSKSDFSEFGAKRKFTQSFMRSEEEGEKERTENREEGRFASGRRSQYRRSTDREEEEEMDDEAIIAAWRRRQEETRTKLQKRRED

SEQ ID NO: 11840 - protein, 1158 aa, Homo sapiens; identical to SEQ ID NO: 11839

SEQ ID NO: 11841 - protein, 1158 aa, Homo sapiens; identical to SEQ ID NO: 11839

SEQ ID NO: 11842 - protein, 176 aa, Homo sapiens
MGPAEAGRRGAASPVPPPLVRVAPSLFLGSARAAGAEEQLARAGVTLCVNVSRQQPGPRAPGVAELRVPVFDDPAEDLLAHLEPTCAAMEAAVRAGGACLVYCKNGRSRSAAVCTAYLMRHRGLSLAKAFQMVKSARPVAEPNPGFWSQLQKYEEALQAQSCLQGEPPALGLGPEA

SEQ ID NO: 11843 - protein, 176 aa, Homo sapiens; identical to SEQ ID NO: 11842

SEQ ID NO: 11844 - protein, 384 aa, Homo sapiens
MEGLGRSCLWLRRELSPPRPRLLLLDCRSRELYESARIGGALSVALPALLLRRLRRGSLSVRALLPGPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 11845 - protein, 568 aa, Homo sapiens
MKWKEKLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 11846 - protein, 588 aa, Homo sapiens; identical to SEQ ID NO: 10277

SEQ ID NO: 11847 - protein, 608 aa, Homo sapiens [sequence omitted]

SEQ ID NO: 11848 - protein, 95 aa, Homo sapiens
MTTPAGSGSGFGSVSWWGLSPALDLQAESPPVDPDSQADTVHSNPELDVLLLGSVDGRHLLRTLSRAKFWPRRRFNVSWDEDESPDSRVLEGGRD

SEQ ID NO: 11849 - protein, 3092 aa, Homo sapiens
MSDANKAAIAAEKEALNLKLPPIVHLPENIGVDTPTQSKLLKYRRSKEQQQKINQLVIDGAKRNLDRTLGKRTPLLPPPDYPQTMTSEMKKKGFNYIYMKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFTGIRAKGPIDCESLKTDLSIQTRNAEEKIMNTWYPKVINLFTKKEALEGVKPEKLDAFYSCVSTLMSNQLKDLLRRTVEGFVKLFDPKDQQRLPIFKIELTFDDDKMEFYPTFQDLEDNVLSLVERIAEALQNVQTIPSWLSGTSTPVNLDTELPEHVLHWAVDTLKAAVHRNLEGARKHYETYVEKYNWLLDGTAVENIETFQTEDHTFDEYTEFIEKFLSLASEIMLLPQWIHYTMVRLDCEDLKTGLTNKAKAFANILLNDIASKYRKENECICSEFEAIKEHALKVPETTEEMMDLISYVEKARTVGIEELILRIQESKRQMSYFLDVFLFPQEDLALNATVLMWPRKINPIFDENDELIENAKHKKENELMAKREKLILEIEKESRRMEEFTEFAELERMQQYVTDVRQLQKRIQESEEAVQFINKEEELFKWELTKYPELDKLKVNIEPYQKFFNFVLKWQRSEKRWMDGGFLDLNGESMEADVEEFSREIFKTLKFFQTKLKKELQEKRKAARKRSLEEEKIEEEPKDNATITMCRMRARHWKQISEIVGYDLTPDSGTTLRKVLKLNLTPYLEQFEVISAGASKEFSLEKAMNTMIGTWEDIAFHISLYRDTGVCILSSVDEIQAILDDQIIKTQTMRGSPFIKPFEHEIKAWEDRLIRIQETIDEWLKVQAQWLYLEPIFCSEDIMQQMPEEGRQFQTVDRHWRDIMKFCAKDPKVLAATSLTGLLEKLQNCNELLEKIMKGLNAYLEKKRLFFPRFFFLSNDEMLEILSETKDPLRVQPHLKKCFEGIAKLEFLPNLDIKAMYSSEGERVELIALISTSAARGAVEKWLIQVEDLMLRSVHDVIAAARLAYPESARRDWVREWPGQVVLCISQMFWTSETQEVISGGTEGLKKYYKELQNQLNEIVELVRGKLSKQTRTTLGALVTIDVHARDVVMDMIKMGVSHDTDFLWLAQLRYYWENENARVRIINCNVKYAYEYLGNSPRLVITPLTDRCYRTLIGAFYLNLGGAPEGPAGTGKTETTKDLAKALAVQCVVFNCSDGLDYLAMGKFFKGLASSGAWACFDEFNRIELEVLSVVAQQILCIQRAIQQKLVVFVFEGTELKLNPNCFVAITMNPGYAGRSELPDNLKVLFRTVAMMVPNYALIAEISLYSYGFLNARPLSVKIVMTYRLCSEQLSSQFHYDYGMRAVKAVLVAAGNLKLKYPNENEDILLLRSIKDVNEPKFLSHDIPLFNGITSDLFPGIKLPEADYHEFLECAHEACNVHNLQPVKFFLEKIIQTYEMMIVRHGFMLVGEPFAAKTKVLHVLADTLTLMNEHGYGEEEKVIYRTVNPKSITMGQLFGQFDPVSHEWTDGIVANTFREFALSETPDRKWVVFDGPIDTLWIESMNTVLDDNKKLCLMSGEIIQMSPQMSLIFETMDLSQASPATVSRCGMIYLEPSQLGWEPLVSSWLNSLKGPLCEPEYQALLRGLFAWLIPPSLNQRVELFQLNYLYTTIVSKILKILITFRISNYFKYVPLKTQCTFIKFFLHQQACFIFSLIWSIGGSCDTDGRRVFDTFIRLIILGKDDENPVPDSVGKWECPFDEKGLVYDYMYELKNKGRWVHWNELIKNTNLGDKQIKIQDIIVPTMDTIRYTFLMDLSITYAKPLLFVGPTGTGKSVYVKDKLMNHLEKDQYFPFYINLSARTSANQVQNIIMARLDKRRKGVFGPPMGKKCIIFIDDMNMPALEKYGAQPPIELLRQFFDCGHWYDLKDTSKITLVDIELIAAMGPPGGGRNPVTPRCIRHFNICSINSFSDETMVRIFSSIVAFYLRTHEFPPEYFVIGNQIVNGTMEIYKQSVENLLPTPTKSHYTFNLRDFSRVIRGCLLIERDAVANKHTMIRLFVHEVLRVFYDRLINDDDRRWLFQLTKTVIKDHFKESFHSIFSHLRKQNAPVTEEDLRNLMFGDYMNPDLEGDDRVYIEIPNIHHFSDVVDQCLDEYNQTHKTRMNLVIFRYVLEHLSRICRVLKQSGGNALLVGLGGSGRQSLTRLATSMAKMHIFQPEISKSYGMNEWREDMKSFIAVPVTNRIVDNKSKILEKRLRYLNDHFTYNLYCNICRSLFEKDKLLFSFLLCANLLLARKEIEYQELMFLLTGGVSLKSAEKNPDPTWLQDKSWEEICRASEFPAFRGLRQHFCEHIYEWREIYDSKEPHNAKFPAPMDKNLNELQKIIILRCLRPDKITPAITNYVTDKLGKKFVEPPPFDLTKSYLDSNCTIPLIFVLSPGADPMASLLKFANDKSMSGNKFQAISLGQGQGPIAAKMIKAAIEEGTWVCLQNCHLAVSWMPMLEKICEDFTSETCNSSFRLWLTSYPSSKFPVTILQNGVKMTNEPPTGLRLNLLQSYLTDPVSDPEFFKGCRGKELAWEKLLFGVCFFHALVQERKKFGPLGWNIPYGFNESDLRISIRQLQLFINEYDTIPFEAISYLTGECNYGGRVTDDWDRRLLLTMLADFYNLYIVENPHYKFSPSGNYFAPPKGTYEDYIEFIKKLPFTQHPEIFGLHENVDISKDLQQTKTLFESLLLTQGGSKQTGASGSTDQILLEITKDILNKLPSDFDIEMALRKYPVRYEESMNTVLVQEMERFNNLIITIRNTLRDLEKAIKGVVVMDSALEALSGSLLVGKVPEIWAKRSYPSLKPLGSYITDFLARLNFLQDWYNSGKPCVFWLSGFFFTQAFLTGAMQNYARKYTTPIDLLGYEFEVIPSDTSDTSPEDGVYIHGLYLDGARWDRESGLLAEQYPKLLFDLMPIIWIKPTQKSRIIKSDAYVCPLYKTSERKGTLSTTGHSTNFVIAMLLKTDQPTRHWIKRGVALLCQLDD

SEQ ID NO: 11850 - protein, 4457 aa, Homo sapiens
MTMAPDVRLEYLEEVASIVLKFKPDKWSKLIGAEENVALFTEFFEKPDVQVLVLTLNAAGMIIPCLGFPQSLKSKGVYFIKTKSENINKDNYRARLLYGDISPTPVDQLIAVVEEVLSSLLNQSENMAGWPQVVSEDIVKQVHRLKNEMFVMSGKIKGKTLLPIPEHLGSLDGTLESMERIPSSLDNLLLHAIETTIIDWSHQIRDVLSKDSAQALLDGLHPLPQVEFEFWDTRLLNLKCIHEQLNRPKVNKIVEILEKAKSCYWPALQNVYTNVTEGLKEANDIVLYLKPLRILLEEMEQADFTMLPTFIAKVLDTICFIWATSEYYNTPARIIVILQEFCNQIIEMTRTFLSPEEVLKGLQGEIEEVLSGISLAVNVLKELYQTYDFCCVNMKLFFKDKEPVPWEFPSSLAFSRINSFFQRIQTIEELYKTAIEFLKLEKIELGGVRGNLLGSLVTRIYDEVFELVKVFADCKYDPLDPGDSNFDRDYADFEIKIQDLDRRLATIFCQGFDDCSCIKSSAKLLYMCGGLMERPLILAEVAPRYSVMLELFDAELDNAKILYDAQMAASEEGNIPLIHKNMPPVAGQLKWSLELQERLEVSMKHLKHVEHPVMSGAEAKLTYQKYDEMMELLRCHREKIYQQWVAGVDQDCHFNLGQPLILRDAASNLIHVNFSKALVAVLREVKYLNFQQQKEIPDSAESLFSENETFRKFVGNLELIVGWYNEIKTIVKAVEFLLIKSELEAIDVKLLSAETTLFWNGEGVFQYIQEVREILHNLQNRMQKAKQNIEGISQAMKDWSANPLFERKDNKKEALLDLDGRIANLNKRYAAVRDAGVKIQAMVAENAELFRADTLSLPWKDYVIYIDDMVLDEFDQFIRKSLSFLMDNMESIAPLFEIRMELDEDGLTFNPTLEVGSDRGFLALIEGLVNDIYNVARLIPRLAKDRMNYKMDLEDNTDLIEMREEVSSLVINAMKEAEEYQDSFERYSYLWTDNLQEFMKNFLIYGCAVTAEDLDTWTDDTIPKTPPTLAQFQEQIDSYEKLYEEVSKCENTKVFHGWLQCDCRPFKQALLSTIRRWGFMFKRHLSNHVTNSLADLEAFMKVARMGLTKPLKEGDYDGLVEVMGHLMKVKERQAATDNMFEPLKQTIELLKTYGEEMPEEIHLKLQELPEHWANTKKLAIQVKLTVAPLQANEVSILRRKCQQFELKQHEFRERFRREAPFSFSDPNPYKSLNKQQKSISAMEGIMEALSKSGGLFEVPVPDYKQLKACHREVRLLKELWDMVVVVNTSIEDWKTTKWKDINVEQMDIDCKKFAKDMRSLDKEMKTWDAFVGLDNTVKNVITSLRAVSELQNPAIRERHWQQLMQATQVKFKMSEETTLADLLQLNLHSYEDEVRNIVDKAVKESGMEKVLKALDSTWSMMEFQHEPHPRTGTMMLKSSEVLVETLEDNQVQLQNLMMSKYLAHFLKEVTSWQQKLSTADSVISIWFEVQRTWSHLESIFIGSEDIRTQLPGDSQRFDDINQEFKALMEDAVKTPNVVEATSKPGLYNKLEALKKSLAICEKALAEYLETKRLAFPRFYFVSSADLLDILSNGNDPVEVSRHLSKLFDSLCKLKFRLDASDKPLKVGLGMYSKEDEYMVFDQECDLSGQVEVWLNRVLDRMCSTLRHEIPEAVVTYEEKPREQWILDYPAQVALTCTQIWWTTEVGLAFARLEEGYENAIRDYNKKQISQLNVLITLLMGNLNAGDRMKIMTICTIDVHARDVVAKMIVVESSQAFTWQAQLRHRWDEEKRHCFANICDAQIQYSYEYLGNTPRLVITPLTDRCYITLTQSLHLIMGGAPAGPAGTGKTETTKDLGRALGTMVYVFNCSEQMDYKSCGNIYKGLAQTGAWGCFDEFNRISVEVLSVIAVQVKCVQDAIRAKKKAFNFLGEIIGLIPTVGIFITMNPGYAGRAELPENLKALFRPCAMVVPDFELICEIMLMAEGFLEARLLARKFITLYTLCKELLSKQDHYDWGLRAIKSVLVVAGSLKRGDPSRAEDQVLMRALRDFNIPKIVTDDLPVFMGLIGDLFPALDVPRKRDLNFEKIIKQSIVELKLQAEDSFVLKVVQLEELLQVRHSVFIVGNAGSGKSQVLKSLNKTYQNLKRKPVAVDLDPKAVTCDELFGIINPVTREWKDGLFSTIMRDLANITHDGPKWIILDGDIDPMWIESLNTVMDDNKVLTLASNERIPLNRTMRLVFEISHLRTATPATVSRAGILYINPADLGWNPVVSSWIERRKVQSEKANLMILFDKYLPTCLDKLRFGFKKITPVPEITVIQTILYLLECLLTEKTVPPDSPRELYELYFVFTCFWAFGGAMFQDQLVDYRVEFSKWWINEFKTIKFPSQGTIFDYYIDPDTKKFLPWTDKVPSFELDPDVPLQASLVHTTETIRIRYFMDLLMEKSWPVMLVGNAGTGKSVLMGDKLESLNTDNYLVQAVPFNFYTTSAMLQGVLEKPLEKKSGRNYGPPGTKKLVYFIDDMNMPEVDKYGTVAPHTLIRQHMDHRHWYDRHKLTLKDIHNCQYVACMNPTSGSFTIDSRLQRHFCVFAVSFPGQEALTTIYNTILTQHLAFRSVSMAIQRISSQLVAAALALHQKITATFLPTAIKFHYVFNLRDLSNIFQGLLFSTAEVLKTPLDLVRLWLHETERVYGDKMVDEKDQETLHRVTMASTKKFFDDLGDELLFAKPNIFCHFAQGIGDPKYVPVTDMAPLNKLLVDVLDSYNEVNAVMNLVLFEDAVAHICRINRILESPRGNALLVGVGGSGKQSLSRLAAYISGLDVFQITLKKGYGIPDLKIDLAAQYIKAAVKNVPSVFLMTDSQVAEEQFLVLINDLLASGEIPGLFMEDEVENIISSMRPQVKSLGMNDTRETCWKFFIEKVRRQLKVILCFSPVGSVLRVRARKFPAVVNCTAIDWFHEWPEDALVSVSARFLEETEGIPWEVKASISFFMSYVHTTVNEMSRVYLATERRYNYTTPKTFLEQIKLYQNLLAKKRTELVAKIERLENGLMKLQSTASQVDDLKAKLAIQEAELKQKNESADQLIQVVGIEAEKVSKEKAIADQEEVKVEVINKNVTEKQKACETDLAKAEPALLAAQEALDTLNKNNLTELKSFGSPPDAVVNVTAAVMILTAPGGKIPKDKSWKAAKIMMGKVDTFLDSLKKFDKEHIPEACLKAFKPYQGNPTFDPEFIRSKSTAAAGLCSWCINIVRFYEVYCDVAPKRQALEEANAELAEAQEKLSRIKNKIAELNANLSNLTSAFEKATAEKIKCQQEADATNRVILLANRLVGGLASENIRWAESVENFRSQGVTLCGDVLLISAFVSYVGYFTKKYRNELMEKFWIPYIHNLKVPIPITNGLDPLSLLTDDADVATWNNQGLPSDRMSTENATILGNTERWPLIVDAQLQGIKWIKNKYRSELKAIRLGQKSYLDVIEQAISEGDTLLIENIGETVDPVLDPLLGRNTIKKGKYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKNFVEEKMGSKFVEGRSVEFSKSYEESSPSTSIFFILSPGVDPLKDVEALGKKLGFTIDNGKLHNVSLGQGQEVVAENALDVAAEKGHWVILQNIHLVARWLGTLDKKLEHYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKGYHEYIDENLPPESPYLYGLHPNAEIGFLTVTSEKLFRTVLEMQPKETDSGAGTGVSREEKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 11851 - protein, 4485 aa, Homo sapiens
MTMAPDVRLEYLEEVASIVLKFKPDKWSKLIGAEENVALFTEFFEKPDVQVLVLTLNAAGMIIPCLGFPQSLKSKGVYFIKTKSENINKDNYRARLLYGDISPTPVDQLIAVVEEVLSSLLNQSENMAGWPQVVSEDIVKQVHRLKNEMFVMSGKIKGKTLLPIPEHLGSLDGTLESMERIPSSLDNLLLHAIETTIIDWSHQIRDVLSKDSAQALLDGLHPLPQVEFEFWDTRLLNLKCIHEQLNRPKVNKIVEILEKAKSCYWPALQNVYTNVTEGLKEANDIVLYLKPLRILLEEMEQADFTMLPTFIAKVLDTICFIWATSEYYNTPARIIVILQEFCNQIIEMTRTFLSPEEVLKGLQGEIEEVLSGISLAVNVLKELYQTYDFCCVNMKLFFKDKEPVPWEFPSSLAFSRINSFFQRIQTIEELYKTAIEFLKLEKIELGGVRGNLLGSLVTRIYDEVFELVKVFADCKYDPLDPGDSNFDRDYADFEIKIQDLDRRLATIFCQGFDDCSCIKSSAKLLYMCGGLMERPLILAEVAPRYSVMLELFDAELDNAKILYDAQMAASEEGNIPLIHKNMPPVAGQLKWSLELQERLEVSMKHLKHVEHPVMSGAEAKLTYQKYDEMMELLRCHREKIYQQWVAGVDQDCHFNLGQPLILRDAASNLIHVNFSKALVAVLREVKYLNFQQQKEIPDSAESLFSENETFRKFVGNLELIVGWYNEIKTIVKAVEFLLIKSELEAIDVKLLSAETTLFWNGEGVFQYIQEVREILHNLQNRMQKAKQNIEGISQAMKDWSANPLFERKDNKKEALLDLDGRIANLNKRYAAVRDAGVKIQAMVAENAELFRADTLSLPWKDYVIYIDDMVLDEFDQFIRKSLSFLMDNMVIDESIAPLFEIRMELDEDGLTFNPTLEVGSDRGFLALIEGLVNDIYNVARLIPRLAKDRMNYKMDLEDNTDLIEMREEVSSLVINAMKEAEEYQDSFERYSYLWTDNLQEFMKNFLIYGCAVTAEDLDTWTDDTIPKTPPTLAQFQEQIDSYEKLYEEVSKCENTKVFHGWLQCDCRPFKQALLSTIRRWGFMFKRHLSNHVTNSLADLEAFMKVARMGLTKPLKEGDYDGLVEVMGHLMKVKERQAATDNMFEPLKQTIELLKTYGEEMPEEIHLKLQELPEHWANTKKLAIQVKLTVAPLQANEVSILRRKCQQFELKQHEFRERFRREAPFSFSDPNPYKSLNKVFLLKGIMEALSKSGGLFEVPVPDYKQLKACHREVRLLKELWDMVVVVNTSIEDWKTTKWKDINVEQMDIDCKKFAKDMRSLDKEMKTWDAFVGLDNTVKNVITSLRAVSELQNPAIRERHWQQLMQATQVKFKMSEETTLADLLQLNLHSYEDEVRNIVDKAVKESGMEKVLKALDSTWSMMEFQHEPHPRTGTMMLKSSEVLVETLEDNQVQLQNLMMSKYLAHFLKEVTSWQQKLSTADSVISIWFEVQRTWSHLESIFIGSEDIRTQLPGDSQRFDDINQEFKALMEDAVKTPNVVEATSKPGLYNKLEALKKSLAICEKALAEYLETKRLAFPRFYFVSSADLLDILSNGNDPVEVSRHLSKLFDSLCKLKFRLDASDKPLKVGLGMYSKEDEYMVFDQECDLSGQVEVWLNRVLDRMCSTLRHEIPEAVVTYEEKPREQWILDYPAQIWWTTEVGLAFARLEEGYENAIRDYNKKQISQLNVLITLLMGNLNAGDRMKIMTICTIDVHARDVVAKMIVESSQAFTWQAQLRHRWDEEKRHCFANICDAQIQYSYEYLGNTPRLVITPLTDRCYITLTQSLHLIMGGAPAGPAGTGKTETTKDLGRALGTMVYVFNCSEQMDYKSCGNIYKGLAQTGAWGCFDEFNRISVEVLSVIAVQVKCVQDAIRAKKKAFNFLGEIIGLIPTVGIFITMNPGYAGRAELPENLKALFRPCAMVVPDFELICEIMLMAEGFLEARLLARKFITLYTLCKELLSKQDHYDWGLRAIKSVLVVAGSLKRGDPSRAEDQVLMRALRDFNIPKIVTDDLPVFMGLIGDLFPALDVPRKRDLNFEKIIKQSIVELKLQAEDSFVLKVVQLEELLQVRHSVFIVGNAGSGKSQVLKSLNKTYQNLKRKPVAVDLDPKAVTCDELFGIINPVTREWKDGLFSTIMRDLANITHDGPKWIILDGDIDPMWIESLNTVMDDNKVLTLASNERIPLNRTMRLVFEISHLRTATPATVSRAGILYINPADLGWNPVVSSWIERRKVQSEKANLMILFDKYLPTCLDKLRFGFKKITPVPEITVIQTILYLLECLLTEKTVPPDSPRELYELYFVFTCFWAFGGAMFQDQLVDYRVEFSKWWINEFKTIKFPSQGTIFDYYIDPDTKKFLPWTDKVPSFELDPDVPLQASLVHTTETIRIRYFMDLLMEKSWPVMLVGNAGTGKSVLMGDKLESLNTDNYLVQAVPFNFYTTSAMLQGVLEKPLEKKSGRNYGPPGTKKLVYFIDDMNMPEVDKYGTVAPHTLIRQHMDHRHWYDRHKLTLKDIHNCQYVACMNPTSGSFTIDSRLQRHFCVFAVSFPGQEALTTIYNTILTQHLAFRSVSMAIQRISSQLVAAALALHQKITATFLPTAIKFHYVFNLRDLSNIFQGLLFSTAEVLKTPLDLVRLWLHETERVYGDKMVDEKDQETLHRVTMASTKKFFDDLGDELLFAKPNIFCHFAQGIGDPKYVPVTDMAPLNKLLVDVLDSYNEVNAVMNLVLFEDAVAHICRINRILESPRGNALLVGVGGSGKQSLSRLAAYISGLDVFQITLKKGYGIPDLKIDLAAQYIKAAVKNVPSVFLMTDSQVAEEQFLVLINDLLASGEIPGLFMEDEVENIISSMRPQVKSLGMNDTRETCWKFFIEKVRRQLKVILCFSPVGSVLRVRARKFPAVVNCTAIDWFHEWPEDALVSVSARFLEETEGIPWEVKASISFFMSYVHTTVNEMSRVYLATERRYNYTTPKTFLEQIKLYQNLLAKKRTELVAKIERLENGLMKLQSTASQVDDLKAKLAIQEAELKQKNESADQLIQVVGIEAEKVSKEKAIADQEEVKVEVINKNVTEKQKACETDLAKAEPALLAAQEALDTLNKNNLTELKSFGSPPDAVVNVTAAVMILTAPGGKIPKDKSWKAAKIMMGKVDTFLDSLKKFDKEHIPEACLKAFKPYQGNPTFDPEFIRSKSTAAAGLCSWCINIVRFYEVYCDVAPKRQALEEANAELAEAQEKLSRIKNKIAELNANLSNLTSAFEKATAEKIKCQQEADATNRVILLANRLVGGLASENIRWAESVENFRSQGVTLCGDVLLISAFVSYVGYFTKKYRNELMEKFWIPYIHNLKVPIPITNGLDPLSLLTDDADVATWNNQGLPSDRMSTENATILGNTERWPLIVDAQLQGIKWIKNKYRSELKAIRLGQKSYLDVIEQAISEGDTLLIENIGETVDPVLDPLLGRNTIKKGKYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKNFVEEKMGSKFVEGRSVEFSKSYEESSPSTSIFFILSPGVDPLKDVEALGKKLGFTIDNGKLHNVSLGQGQEVVAENALDVAAEKGHWVILQVRGGQHCRNIHLVARWLGTLDKKLEHYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKGYHEYIDENLPPESPYLYGLHPNAEIGFLTVTSEKLFRTVLEMQPKETDSGAGTGVSREEKAGSLKLLPSERKGEDLELRRGGCPGTGFQVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 11852 - protein, 514 aa, Homo sapiens
MADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 11853 - protein, 4374 aa, Homo sapiens
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 11854 - protein, 581 aa, Homo sapiens
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 11855 - protein, 533 aa, Homo sapiens
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 11856 - protein, 504 aa, Homo sapiens
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 11857 - protein, 593 aa, Homo sapiens
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 11858 - protein, 581 aa, Homo sapiens; identical to SEQ ID NO: 11854

SEQ ID NO: 11859 - protein, 396 aa, Homo sapiens
MSVIVFKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 11860 - protein, 794 aa, Homo sapiens
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEELKALKVREGQAVASTRELKLQLQELSDTWQAHLARGGRWKESPRKLVVGELQDELMSVRLREAQALAEGRELRQRVVELETQDHIHRNLLNRVEAERAALQEKLQYLAAQNKGLQTQLSESRRKQAEAECKSKEEVMAVRLREADSMAAVAEMRQRIAELEIQREEGRIQGQLNHSDSSQYIRELKDQIEELKAEVRLLKGPPPFEDPLAFDGLSLARHLDEDSLPSSDEELLGVGVGAALQDALYPLSPRDARFFRRLERPAKDSEGSSDSDADELAAPYSQGLDN

SEQ ID NO: 11861 - protein, 805 aa, Homo sapiens
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKESAALADRLIQGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEELKALKVREGQAVASTRELKLQLQELSDTWQAHLARGGRWKESPRKLVVGELQDELMSVRLREAQALAEGRELRQRVVELETQDHIHRNLLNRVEAERAALQEKLQYLAAQNKGLQTQLSESRRKQAEAECKSKEEVMAVRLREADSMAAVAEMRQRIAELEIQREEGRIQGQLNHSDSSQYIRELKDQIEELKAEVRLLKGPPPFEDPLAFDGLSLARHLDEDSLPSSDEELLGVGVGAALQDALYPLSPRDARFFRRLERPAKDSEGSSDSDADELAAPYSQGLDN

SEQ ID NO: 11862 - protein, 2579 aa, Homo sapiens
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 11863 - protein, 1356 aa, Homo sapiens
MIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNR

SEQ ID NO: 11864 - protein, 507 aa, Homo sapiens
TTPVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 11865 - protein, 211 aa, Homo sapiens
MNRKKLQKLTDTLTKNCKHFNKFEVNCLIKLFYDLVGGVERQGLVVGLDRNAFRNILHVTFGMTDDMIMDRVFRGFDKDNDGCVNVLEWIHGLSLFLRGSLEEKMKYCFEVFDLNGDGFISKEEMFHMLKNSLLKQPSEEDPDEGIKDLVEITLKKMDHDHDGKLSFADYELAVREETLLLEAFGPCLPDPKSQMEFEAQVFKDPNEFNDM

SEQ ID NO: 11866 - protein, 159 aa, Homo sapiens
MNRKKLQKLTDTLTKNCKHLFRGFDKDNDGCVNVLEWIHGLSLFLRGSLEEKMKYCFEVFDLNGDGFISKEEMFHMLKNSLLKQPSEEDPDEGIKDLVEITLKKMDHDHDGKLSFADYELAVREETLLLEAFGPCLPDPKSQMEFEAQVFKDPNEFNDM

SEQ ID NO: 11867 - protein, 211 aa, Homo sapiens; identical to SEQ ID NO: 11865

SEQ ID NO: 11868 - protein, 129 aa, Homo sapiens
  MOD_RES (1)..(1): Any amino acid
XVNVLEWIHGLSLFLRGSLEEKMKYCFEVFDLNGDGFISKEEMFHMLKNSLLKQPSEEDPDEGIKDLVEITLKKMDHDHDGKLSFADYELAVREETLLLEAFGPCLPDPKSQMEFEAQVFKDPNEFNDM

SEQ ID NO: 11869 - protein, 159 aa, Homo sapiens; identical to SEQ ID NO: 11866

SEQ ID NO: 11870 - protein, 127 aa, Homo sapiens
METSSRELQAAEYLEKHQIKEVVSYLTSALLFFRPEKPKEYLISLLERLRIAKVTGVAFPFFMDNSNIVAMFEMMDSSGRGTISFVQYKEALKTLGLCTEDEDLQDDGHKITLDKFKEEVNKRMKEI

SEQ ID NO: 11871 - protein, 149 aa, Homo sapiens
MSSINPNTSGILLEGFLNIVRKKKEAQRYRNEVRHIFTAFDTYYRGFLTLEDFKKAFRQVAPKLPERTVLEVFRGLRIFSKCLLCHIDQKSKNPSSGLLAADSIIQAHPSPVQILRQMYINNELEGRGFIWDSSISWRFMWNIYGTGEY

SEQ ID NO: 11872 - protein, 163 aa, Homo sapiens
MFFSEARARSRTWEASPSEHRKWVEVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFREVDRDSDGHVSFRDFEYALNYGQKEA

SEQ ID NO: 11873 - protein, 139 aa, Homo sapiens
MVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFREVDRDSDGHVSFRDFEYALNYGQKEA

SEQ ID NO: 11874 - protein, 118 aa, Homo sapiens
MVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFRGIFSA

SEQ ID NO: 11875 - protein, 784 aa, Homo sapiens
METKVHLFCQAEENIDLLDDGSNSFATDLSSGTINHKKYIKFSKTIEKEISPEIRSLSPEYKKIFETSIIFCGEEKSSDFSGEKKVGRKSLQVQQHSKRTEIIPPFLKLSKEKVTRKENSLCKLPNQYSVHKTSSPLCTSSAITREKEMLSNLYMTLYDEVTHGYLHSKELSGNHMVDIGDIIFTLNELQEQYEDVSITEGSPLNEITSDRKLSSVAGCYLKYKKKNSLSSKLPEPSISKKLNKKSNQYYSKIMENDDLESKRPKNTWQIRKFLGGVGSSNVGVQEPYSKNGINFKKHSEKGEIHDSKSKPQSLKSSTSLSKSLDKSDISSIPKLQKPAVRKHSSLQKQVSSTEKTAISTLENFCEAISKLQENYIAAEELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKKVNFKEFIDTMMSNTECFSEKLVLPDAIETLDDLRKETMSVSDLWNTLSSLNSNLKKDEFLAALELVTVDEGDKVQFEEFAKVVRNMRDAARLEELQEVVLAADLLEGDMIAGKNLEDFLRNVGIKSPKEEVEKILQSDFVSEDNMVNIKDCMRALRDTQKFSNYIDFRKEASNLKLPKVNEIKEAANILSHVDNGKIGIPDLEHALKCLNVNLTEEDFNEALNCCNVSDNMEVDLKDFLMKMKESPHFQKSKATQILLATTQILQNDLVDVSDLKTLLMDKDLHTANAILTVMLRHVPEHG

SEQ ID NO: 11876 - protein, 269 aa, Homo sapiens
MLGPGQVRLRPRVWRDKAGGRVADGASGLPPARGSWRETGTGRALGASSPPRPAQGSSSPGIQSGPSSRPGSPRGAEQAGTPRPRLSLGISQATGSAARWRTRRTGKGLGYNSDEIRPRTLLIEHLMEGGRRDHHTMTVLWGTQEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEDGVSLRRPG

SEQ ID NO: 11877 - protein, 162 aa, Homo sapiens
MADEKDREEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEGEPFSQEEMEEMLSAAIDPESNSINYKDYITMMVIDEN

SEQ ID NO: 11878 - protein, 133 aa, Homo sapiens
MADEKDREEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEDGVSLRRPG

SEQ ID NO: 11879 - protein, 438 aa, Homo sapiens
MAVSEIKPKLKLNPLTKVPISHNKRDRDLPGSLQCQLQHKEKKLSASQMAAFQDAYNFFYKDKTGCIDFHGLMCTVAKLGMNLTKHDVYNELKCADIDRDGKVNFSDFIKVLTDKNLFLKAVVPEKETCLDLAGNPGILLFEILSRLLETSALPRKSIIEIVSYFQRKFQHTGPGMLWSPYTMGYGKRTLKPDICTPPSSSMAAFANAARIAIMKEKDLFKFLEELKRCNSGSDSPYSKIPIFPLFPNVDGVVMGKPFKDMQKLEMLRIKEPLHFFEDYFFHKRDWKTQAANIKSMDPASGYSNNIFTIDQMLKKKQTCTVADATAIKQHVKRATDTYNLGIALEHRKEMLNLWQKIRGDLIGMDSRNESFYDTFSTYTWSWNVCQELLSPKDLRLYDAYVNRNSSHNSRSSSSSDTSECYTDSGRKRKRKGLKGFQQ

SEQ ID NO: 11880 - protein, 162 aa, Homo sapiens
MAVSEIKPKLKLNPLTKVPISHNKRDRDLPGSLQCQLQHKEKKLSASQMAAFQDAYNFFYKDKTGCIDFHGLMCTVAKLGMNLTKHDVYNELKCADIDRDGKVNFSDFIKVLTDKNLFLKAVVPEKETCLDLAGNPGILLFEILSRLLETSALPRKSIIEIV

SEQ ID NO: 11881 - protein, 174 aa, Homo sapiens
MAVSEIKPKLKLNPLTKVPISHNKRDRDLPGSLQCQLQHKEKKLSASQMAAFQDAYNFFYKDKTGCIDFHGLMCTVAKLGMNLTKHDVYNELKCADIDRDGKVNFSDFIKVLTDKNLFLKAVVPEKETCLDLAGNPGILLFEILSRLLETSALPRKSIIEIVSYFQRKFQHTGP

SEQ ID NO: 11882 - protein, 490 aa, Homo sapiens
MKELMPHLTFNGNGKINVNSIMEGLKKFKPKGMVTLHKLKTANDIKDRVTGHMAVSEIKPKLKLNPLTKVPISHNKRDRDLPGSLQCQLQHKEKKLSASQMAAFQDAYNFFYKDKTGCIDFHGLMCTVAKLGMNLTKHDVYNELKCADIDRDGKVNFSDFIKVLTDKNLFLKAVVPEKETCLDLAGNPGILLFEILSRLLETSALPRKSIIEIVSYFQRKFQHTGPGMLWSPYTMGYGKRTLKPDICTPPSSSMAAFANAARIAIMKEKDLFKFLEELKRCNSGSDSPYSKIPIFPLFPNVDGVVMGKPFKDMQKLEMLRIKEPLHFFEDYFFHKRDWKTQAANIKSMDPASGYSNNIFTIDQMLKKKQTCTVADATAIKQHVKRATDTYNLGIALEHRKEMLNLWQKIRGDLIGMDSRNESFYDTFSTYTWSWNVCQELLSPKDLRLYDAYVNRNSSHNSRSSSSSDTSECYTDSGRKRKRKGLKGFQQ

SEQ ID NO: 11883 - protein, 1379 aa, Homo sapiens
MNESASQEELRPAQENRKEDKERKWNLTEVKELHETLQSVPDVPVKEDTNSVVEKAMDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTAKLHIQFPKPHPGHEVRLSSKQFQNYIELVVSELRGNEDQVLESVVEFLMNALERSHIESLRNSARRKWLHQIQCAAETSGVSLEPVYSETFKALMQDAEAHGNKKISAHISLLEENLLLPEKGNVLLRNVACTLDDAQFVLNRVLYRDMKGISFTVVDEGKPIHVPQVQYHGNIFFWNQSRNKHDYNGSFLALPLQDAYMRIFGVLAVDTLRDPHEINIFLPHEIRFYQGVANVFSTAYHYVHSREHILHIVITGIGWLYDVTSSITSITTYFVEPSPAQDSDYVLRNMMVTGQLGLTEIHKNPPTIHRKSCIFRDFLFKCTDSSEVVLASACGETHIVVPLRERTGEALGVLDFNIGQNRMLLCQEYKDLQKMMKVVQVACYEILGEFSGEIKKKYILEIENVREVQRAGILFFRIMLLELQESIQLLNSMEFVSLLLYDHTLVTEPNSPQDSKSMELEANVKLVRDILKAVILFFHPELEFSSDFGSWDKCKFYVNKYLVNNICAFDPTAKHVEVNVQLIDEYIRDHSRTEVWKFGNVVIEHLYHWIHICSALMKITKQLNSGITPPLPSKTDNYMYAKMPGEGLQEK

SEQ ID NO: 11884 - protein, 926 aa, Homo sapiens
MNESASQEELRPAQENRKEDKERKWNLTEVKELHETLQSVPDVPVKEDTNSVVEKAMDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQFSQNAFQVRQRLLLEAIFQKWDSDGSGFLDLKEVDELLYTYKEGMEKESMKKGLTLSPGWSAVAQL

SEQ ID NO: 11885 - protein, 975 aa, Homo sapiens
MNESASQEELRPAQENRKEDKERKWNLTEVKELHETLQSVPDVPVKEDTNSVVEKAMDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQFSQNAFQVRQRLLLEAIFQKWDSDGSGFLDLKEVDELLYTYKEGMEKESMKKDHSRTEVWKFGNVVIEHLYHWIHICSALMKITKQLNSGITPPLPSKTDNYMYAKMPGEGLQEK

SEQ ID NO: 11886 - protein, 1503 aa, Homo sapiens
MNESASQEELRPAQENRKEDKERKWNLTEVKELHETLQSVPDVPVKEDTNSVVEKAMDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQFSQNAFQVRQRLLLEAIFQKWDSDGSGFLDLKEVDELLYTYKEGMEKESMKKAKLHIQFPKPHPGHEVRLSSKQFQNYIELVVSELRGNEDQVLESVVEFLMNALERSHIESLRNSARRKWLHQIQCAAETSGVSLEPVYSETFKALMQDAEAHGNKKISAHISLLEENLLLPEKGNVLLRNVACTLDDAQFVLNRVLYRDMKGISFTVVDEGKPIHVPQVQYHGNIFFWNQSRNKHDYNGSFLALPLQDAYMRIFGVLAVDTLRDPHEINIFLPHEIRFYQGVANVFSTAYHYVHSREHILHIVITGIGWLYDVTSSITSITTYFVEPSPAQDSDYVLRNMMVTGQLGLTEIHKNPPTIHRKSCIFRDFLFKCTDSSEVVLASACGETHIVVPLRERTGEALGVLDFNIGQNRMLLCQEYKDLQKMMKVVQVACYEILGEFSGEIKKKYILEIENVREVQRAGILFFRIMLLELQESIQLLNSMEFVSLLLYDHTLVTEPNSPQDSKSMELEANVKLVRDILKAVILFFHPELEFSSDFGSWDKCKFYVNKYLVNNICAFDPTAKHVEVNVQLIDEYIRDHSRTEVWKFGNVVIEHLYHWIHICSALMKITKQLNSGITPPLPSKTDNYMYAKMPGEGLQEK

SEQ ID NO: 11887 - protein, 856 aa, Homo sapiens
LGQMKCKELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQVSLCRQAGVQWRNCSSLQPPTPGLKRSSHHRLLSNWDYRERRKFFPLETKFP

SEQ ID NO: 11888 - protein, 508 aa, Homo sapiens
MKENVKQNRKQRESIDKIIVKVANTRKQALQEQFDEWILDPKGMIPKSVLQIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNW

SEQ ID NO: 11889 - protein, 856 aa, Homo sapiens
MDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQVSLCRQAGVQWRNCSSLQPPTPGLKRSSHHRLLSNWDYRERRKFFPLETKFP

SEQ ID NO: 11890 - protein, 569 aa, Homo sapiens
MEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQVSLCRQAGVQWRNCSSLQPPTPGLKRSSHHRLLSNWDYRERRKFFPLETKFP

SEQ ID NO: 11891 - protein, 629 aa, Homo sapiens
MAISPRSDATFSSQKSTPSESPRTKKFPLTEEEIFYMNCRAAYLTVFKSSLENIISKDQLYLALQHAGRNPSQKTINKYWTPQTAKLNFDDFCIILRKEKPTSKAELLKSFKQLDVNDDGCILHTDLYKFLTKRGEKMTREEVNAIINLADVNADGKFDYIKFCKLYMTTNEQCLKTTLEKLEVDSKLMRHQFGNHIEGSPERDPSPVPKPSPKITRKTDPETFLNKGDTRSSLLSATRKFKTSVSFTVTMGANGNRNSKLMEPNLIKDWQHMQSKGCFFLEEDGEIISHQYRMQIAQRSMVYLTIKPLNLSQVEGKPSPWLSVDTALYILKENESQANLQLVCFTELRNREVFGWTGELGPGIYWLIPSTTGCRLRKKIKPVTDEAQLVYRDETGELFLTKEFKSTLSDIFEVIDLDGNGLLSLEEYNFFELRTSGEKCDEDAWAVCRENFDTKRNELTRQGFMDLNLMEANDREGDPCDLWVTLHSMGYNKALELTEACPFVIDIYAEKCKPKIKAVHMEACSGQLEKAICKSVLSNGDAKVMDGYENIIVHTYSCDTWITSVIENKSDEKVIIHISNELSKNCINNRGLNIFAVEVGPKSTMVCQHVMPLNERQEWIYYCIYSLIS

SEQ ID NO: 11892 - protein, 197 aa, Homo sapiens
MRLKQGSFLWYLYLDKIYCLLSVRNVKALAEYFHILDVHGKNTLNDVLFYHFLHHVTDLKKAQINIVFDMLDWNAVGEIDFEKFYMLVCMLLAHQNHLEGQFMYRHSRPVFDLLDLKGDLRIGAKNFEMYRFLFNIQKQELKDLFRDFDITGDNRLNYQEFKLYTIIYTDKLQKRQKTEEKEKGERKRSLYSKCHIK

SEQ ID NO: 11893 - protein, 817 aa, Homo sapiens
MYGVCGCCGALRPRYKRLVDNIFPEDPEDGLVKTNMEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 11894 - protein, 782 aa, Homo sapiens
MEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 11895 - protein, 1523 aa, Homo sapiens
MTSVWKRLQRVGKRAAKFQFVACYHELVLECTKKWQPDKLVVVWTRRNRRICSKAHSWQPGIQNPYRGTVVWMVPENVDISVTLYRDPHVDQYEAKEWTFIIENESKGQRKVLATAEVDLARHAGPVPVQVPVRLRLKPKSVKVVQAELSLTLSGVLLREGRATDDDMQSLASLMSVKPSDVGNLDDFAESDEDEAHGPGAPEARARVPQPDPSRELKTLCEEEEEGQGRPQQAVASPSNAEDTSPAPVSAPAPPARTSRGQGSERANEAGGQVGPEAPRPPETSPEMRSSRQPAQDTAPTPAPRLRKGSDALRPPVPQGEDEVPKASGAPPAGLGSARETQAQACPQEGTEAHGARLGPSIEDKGSGDPFGRQRLKAEEMDTEDRPEASGVDTEPRSGGREANTKRSGVRAGEAEESSAVCQVDAEQRSKVRHVDTKGPEATGVMPEARCRGTPEAPPRGSQGRLGVRTRDEAPSGLSLPPAEPAGHSGQLGDLEGARAAAGQEREGAEVRGGAPGIEGTGLEQGPSVGAISTRPQVSSWQGALLSTAQGAISRGLGGWEAEAGGSGDLETETEVVGLEVLGTQEKEVEGSGFPETRTLEIEILGALEKEAARSRVLESEVAGTAQCEGLETQETEVGVIETPGTETEVLGTQKTEAGGSGVLQTRTTIAETEVLVTQEISGDLGPLKIEDTIQSEMLGTQETEVEASRVPESEAEGTEAKILGTQEITARDSGVREIEAEIAESDILVAQEIEVGLLGVLGIETGAAEGAILGTQEIASRDSGVPGLEADTTGIQVKEVGGSEVPEIATGTAETEILGTQEIASRSSGVPGLESEVAGAQETEVGGSGISGPEAGMAEARVLMTRKTEIIVPEAEKEEAQTSGVQEAETRVGSALKYEALRAPVTQPRVLGSQEAKAEISGVQGSETQVLRVQEAEAGVWGMSEGKSGAWGAQEAEMKVLESPENKSGTFKAQEAEAGVLGNEKGKEAEGSLTEASLPEAQVASGAGAGAPRASSPEKAEEDRRLPGSQAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNAVAGRASKDGGAEAPRESRPAEVPAEGLVNGAGAPGGGGVRLRRPSVNGEPGSVPPPRAHGSFSHVRDADLLKKRRSRLRNSSSFSMDDPDAGAMGAAAAEGQAPDPSPAPGPPTAADSQQPPGGSSPSEEPPPSPGEEAGLQRFQDTSQYVCAELQALEQEQRQIDGRAAEVEMQLRSLMESGANKLQEEVLIQEWFTLVNKKNALIRRQDQLQLLMEEQDLERRFELLSRELRAMLAIEDWQKTSAQQHREQLLLEELVSLVNQRDELVRDLDHKERIALEEDERLERGLEQRRRKLSRQLSRRERCVLS

SEQ ID NO: 11896 - protein, 334 aa, Homo sapiens
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCRDITKEEISKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 11897 - protein, 326 aa, Homo sapiens
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCSKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 11898 - protein, 391 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQQFPFCLMSVNITHIAIQALREECLSRECNRQQKVIPVVNSFYAATFLHLAHVWRTQRKTISDSGFVLKGVLFLLGRPRLNAQCPRSREPKVVARLVLAAVLPHPHFLKFQLTKISITHPLESASSPFSALTVALFWSYTYDKHIF

SEQ ID NO: 11899 - protein, 381 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQQFPFCLMSVNITHIAIQALREECLSRECNRQQKVIPVVNSFYAATFLHLAHVWRTQRKTISDSGFVLKELEVLAKKSPRRLLKTLELYLARVSKGQASLLGAQKCYGPEAPPFKDLTFTGESDLQSHSSEGVWLI

SEQ ID NO: 11900 - protein, 381 aa, Homo sapiens; identical to SEQ ID NO: 11899

SEQ ID NO: 11901 - protein, 203 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQG

SEQ ID NO: 11902 - protein, 381 aa, Homo sapiens; identical to SEQ ID NO: 11899

SEQ ID NO: 11903 - protein, 381 aa, Homo sapiens; identical to SEQ ID NO: 11899

SEQ ID NO: 11904 - protein, 120 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFK

SEQ ID NO: 11905 - protein, 254 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQIERNQGKG

SEQ ID NO: 11906 - protein, 1120 aa, Homo sapiens
MVLNSLDKMIQLQKNTANIRNICVLAHVDHGKTTLADCLISSNGIISSRLAGKLRYMDSREDEQIRGITMKSSAISLHYATGNEEYLINLIDSPGHVDFSSEVSTAVRICDGCIIVVDAVEGVCPQTQAVLRQAWLENIRPVLVINKIDRLIVELKFTPQEAYSHLKNILEQINALTGTLFTSKVLEERAERETESQVNPNSEQGEQVYDWSTGLEDTDDSHLYFSPEQGNVVFTSAIDGWGFGIEHFARIYSQKIGIKKEVLMKTLWGDYYINMKAKKIMKGDQAKGKKPLFVQLILENIWSLYDAVLKKDKDKIDKIVTSLGLKIGAREARHSDPKVQINAICSQWLPISHAVLAMVCQKLPSPLDITAERVERLMCTGSQTFDSFPPETQALKAAFMKCGSEDTAPVIIFVSKMFAVDAKALPQNKPRPLTQEEIAQRRERARQRHAEKLAAAQGQAPLEPTQDGSAIETCPKGEEPRGDEQQVESMTPKPVLQEENNQESFIAFARVFSGVARRGKKIFVLGPKYSPLEFLRRVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFEEQGASDLAKEGQEENETCSGGNENQELQDGCSEAFEKRTSQKGESPLTDCYGPFSGQLIATMKEACRYALQVKPQRLMAAMYTCDIMATGDVLGRVYAVLSKREGRVLQEEMKEGTDMFIIKAVLPVAESFGFADEIRKRTSGLASPQLVFSHWEIIPSDPFWVPTTEEEYLHFGEKADSENQARKYMNAVRKRKGLYVEEKIVEHAEKQRTLSKNK

SEQ ID NO: 11907 - protein, 1069 aa, Homo sapiens
MVLNSLDKMIQLQKNTANIRNICVLAHVDHGNEEYLINLIDSPGHVDFSSEVSTAVRICDGCIIVVDAVEGVCPQTQAVLRQAWLENIRPVLVINKIDRLIVELKFTPQEAYSHLKNILEQINALTGTLFTSKVLEERAERETESQVNPNSEQGEQVYDWSTGLEDTDDSHLYFSPEQGNVVFTSAIDGWGFGIEHFARIYSQKIGIKKEVLMKTLWGDYYINMKAKKIMKGDQAKGKKPLFVQLILENIWSLYDAVLKKDKDKIDKIVTSLGLKIGAREARHSDPKVQINAICSQWLPISHAVLAMVCQKLPSPLDITAERVERLMCTGSQTFDSFPPETQALKAAFMKCGSEDTAPVIIFVSKMFAVDAKALPQNKPRPLTQEEIAQRRERARQRHAEKLAAAQGQAPLEPTQDGSAIETCPKGEEPRGDEQQVESMTPKPVLQEENNQESFIAFARVFSGVARRGKKIFVLGPKYSPLEFLRRVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFEEQGASDLAKEGQEENETCSGGNENQELQDGCSEAFEKRTSQKGESPLTDCYGPFSGQLIATMKEACRYALQVKPQRLMAAMYTCDIMATGDVLGRVYAVLSKREGRVLQEEMKEGTDMFIIKAVLPVAESFGFADEIRKRTSGLASPQLVFSHWEIIPSDPFWVPTTEEEYLHFGEKADSENQARKYMNAVRKRKGLYVEEKIVEHAEKQRTLSKNK

SEQ ID NO: 11908 - protein, 30 aa, Homo sapiens
MVLNSLDKMIQLQKNTANIRNICVLAHVDH

SEQ ID NO: 11909 - protein, 17 aa, Homo sapiens
MVLNSLDKMIQLQKNTA

SEQ ID NO: 11910 - protein, 139 aa, Homo sapiens
MWHTVPRAGLGRVGCRGLPGCRAHPPGAWACCTEQAWALAPLTVPSRPSLCSGPRTGSGQQAPGLQDVLSLWSVCDDEHSWSFLYAGPWASERATGWRLSHEVEGQSQGLQVTSCRHHALLPWAVLGAPSWPWAQWPVA

SEQ ID NO: 11911 - protein, 102 aa, Homo sapiens
MGAEWELGAEAGGSLLLCAALLAAGCALGLRLGRGQGAADRGALIWLCYDALVHFALAFPADHPVRVRAVWLLDDLPPRVAHQKPQPQHQQLAVLLALPVFF

SEQ ID NO: 11912 - protein, 128 aa, Homo sapiens
MGAEWELGAEAGGSLLLCAALLAAGCALGLRLGRGQGAADRGALIWLCYDALVHFALEGPFVYLSLVGNVANSDGLIASLSDARWVYFDPTIVSVEILTVALDGSLALFLIYAIVKEKYYRDRVAWGE

SEQ ID NO: 11913 - protein, 604 aa, Homo sapiens
MLGMNMLLITLFLLLPLSMLKGEPWEGCLHCTHTTWSGNIMTKTLLYHTYYECAGTCLGTCTHNQTTYSVCDPGRGQPYVCYDPKSSPGTWFEIHVGSKEGDLLNQTKVFPSGKDVVSLYFDVCQIVSMGSLFPVIFSSMEYYSSCHKNRYAHPACSTDSPVTTCWDCTTWSTNQQSLGPIMLTKIPLEPDCKTSTCNSVNLTILEPDQPIWTTGLKAPLGARVSGEEIGPGAYVYLYIIKKTRTRSTQQFRVFESFYEHVNQKLPEPPPLASNLFAQLAENIASSLHVASCYVCGGMNMGDQWPWEARELMPQDNFTLTASSLEPAPSSQSIWFLKTSIIGKFCIARWGKAFTDPVGELTCLGQQYYNETLGKTLWRGKSNNSESPHPSPFSRFPSLNHSWYQLEAPNTWQAPSGLYWICGPQAYRQLPAKWSGACVLGTIRPSFFLMPLKQGEALGYPIYDETKRKSKRGITIGDWKDNEWPPERIIQYYGPATWAEDGMWGYRTPVYMLNRIIRLQAVLEIITNETAGALNLLAQQATKMRNVIYQNRLALDYLLAQEEGVCGKFNLTNCCLELDDEGKVIKEITAKIQKLAHIPVQTWKG

SEQ ID NO: 11914 - protein, 563 aa, Homo sapiens
MGSLSNYALLQLTLTAFLTILVQPQHLLAPVFRTLSILTNQSNCWLCEHLDNAEQPELVFVPASASTWWTYSGQWMYERVWYPQAEVQNHSTSSYRKVTWHWEASMEAQGLSFAQVRLLEGNFSLCVENKNGSGPFLGNIPKQYCNQILWFDSTDGTFMPSIDVTNESRNDDDDTSVCLGTRQCSWFAGCTNRTWNSSAVPLIGLPNTQDYKWVDRNSGLTWSGNDTCLYSCQNQTKGLLYQLFRNLFCSYGLTEAHGKWRCADASITNDKGHDGHRTPTWWLTGSNLTLSVNNSGLFFLCGNGVYKGFPPKWSGRCGLGYLVPSLTRYLTLNASQITNLRSFIHKVTPHRCTQGDTDNPPLYCNPKDNSTIRALFPSLGTYDLEKAILNISKAMEQEFSATKQTLEAHQSKVSSLASASRKDHVLDIPTTQRQTACGTVGKQCCLYINYSEEIKSNIQRLHEASENLKNVPLLDWQGIFAKVGDWFRSWGYVLLIVLFCLFIFVLIYVRVFRKSRRSLNSQPLNLALSPQQSAQLLVSETSCQVSNRAMKGLTTHQYDTSLL

SEQ ID NO: 11915 - protein, 563 aa, Homo sapiens; identical to SEQ ID NO: 11914

SEQ ID NO: 11916 - protein, 535 aa, Homo sapiens
MTEKFLFLYLSLLPMPLLSQAQWNENSLVSFSKIIASGNHLSNCWICHNFITRSSSYQYILVRNFSLNLTFGSGIPEGQHKSVPLQVSLANSAHQVPCLDLTPPFNQSSKTSFYFYNCSSLNQTCCPCPEGHCDRKNTSEEGFPSPTIHPMSFSPAGCHPNLTHWCPAKQMNDYRDKSPQNRCAAWEGKELITWRVLYSLPKAHTVPTWPKSTVPLGGPLSPACNQTIPAGWKSQLHKWFDSHIPRWACTPPGYVFLCGPQKNKLPFDGSPKITYSTPPVANLYTCINNIQHTGECAVGLLGPRGIGVTIYNTTQPRQKRALGLILAGMGAAIGMIAPWGGFTYHDVTLRNLSRQIDNIAKSTRDSISKLKASIDSLANVVMDNRLALDYLLAEQGGVCAVINKSCCVYVNNSGAIEEDIKKIYDEATWLHDFGKGGASARAIWEAVKSALPSLNWFVPLLGPATVILLLFLFGPCFFNLLIKCVSSRIKQFHMKSPQMERYQLSVIGGPSTYKHISPLDASGQRFRETMEEFSL

SEQ ID NO: 11917 - protein, 264 aa, Homo sapiens
MALEAAGGPPEETLSLWKREQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSGEGQPPQDHSPGPRTAPRPGSQEQAGKDWQ

SEQ ID NO: 11918 - protein, 282 aa, Homo sapiens
MALEAAGGPPEETLSLWKREQARLKAHVVDRDTEAWQRDPAFSGLQRVGGVDVSFVKGDSVRACASLVVLSFPELEVVYEESRMVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 11919 - protein, 237 aa, Homo sapiens
MALEAAGGPPEETLSLWKREQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 11920 - protein, 256 aa, Homo sapiens
MDPTCSSECIYNLIPSDLKEPPQPPRYISIFKATVKDDMQKAKTAMKTMGPAKVEVPSPKDFLKKHSKEKTLPPKKNFDRNVPKKPAVPLKTDHPVMGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSIPKKIRKQRLEEEMKQLEHDIGIIEKHKIIYIANNA

SEQ ID NO: 11921 - protein, 255 aa, Homo sapiens
MDPTCSSECIYNLIPSDLKEPPQPPRYISIFKATVKDDMQKAKTAMKTMGPAKVEVPSPKDFLKKHSKEKTLPPKKNFDRNVPKKPAVPLKTDHPVMGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSIPKKIRKQRLEEEMKQLEHDIGIIEKHKIIYIANK

SEQ ID NO: 11922 - protein, 256 aa, Homo sapiens; identical to SEQ ID NO: 11920

SEQ ID NO: 11923 - protein, 434 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 11924 - protein, 628 aa, Homo sapiens
MEEEGGGRSCGTTRELQKLKQQAMEYYRENDVPRRLEELLNSTFYLQPADVYGHLKANCFSKLAKPPTICKIVGKDVLDGLGLPTLQVDIFCTIQNFPKNVCSVVISTHFEVHENALPELAKAEEAERASAVSTAVQWVNSTITHELQGMAPSDQAEVDHLLRIFFASKVQEDKGRKELEKSLEYSTVPTPLPPVPPPPPPPPPTKKKGQKPGRKDTITEKPIAPAEPVEPVLSGSMAIGAVSLAVAKACAMLLNKPLYLNIALLKHNQEQPTTLSMPLLMVSLVSCGKSSSGKLNLMKEVICIPHPELTTKQGVEMLMEMQKHINKIIEMVSPSPPKAETKKGHDGSKRGQQQITGKMSHLGCLTINCDSIEQPLLLIQEICANLGLELGTNLHLAINCAGHELMDYNKGKYEVIMGTYKNAAEMVDLYVDLINKYPSIIALIDPFRKEDSEQWDSIYHALGSRCYIIAGTASKSISKLLEQGNISIPKSNGLIIKHTNQTTMSDLVEITNLIDSKKHITVFGSTEGESSDDSLVDLAVGLGVRFIKLGGLSRGERVTKYNRLLTIEEELVQNGTLGFKEEHTFFYFNEEAEKAAEALEAAAAREPLVPTFPTQGVEESAETGASSG

SEQ ID NO: 11925 - protein, 607 aa, Homo sapiens
MAFRRQVKNFVKNYSDAEIKVREATSNDPWGPSSSLMLDISDLTFNTISLSEIMNMLWHRLNDHGKNWRHVYKSLTLMDYLIKNGSKKVIQHCREGFCNLQTLKDFQHIDEAGKDQGYYIREKSKQVITLLMDEPLLCKEREVACRTRQRTSHSILFSKRQLGSSNSLTACTSAPTPDISASEKKYKLPKFGRLHNKRNVCKAGLKQEHCQDVHLPTETMLSQETLPLKIHGWKSTEDLMTFLDDDPELPLLATPPSIVSPITCLSEAEEVCNLSGADAVPTLSENSPSGQRDVSLDKRSDGIFTNTVTENLLETPLEKQSAAEGLKTLTILPACWSSKEEFISPDLRVSKSDSTFHNQASVETLCLSPSFKIFDRVKEIVINKAYQKPAQSSIQMDDKILKTTTRVSTASEGASSFSPLSMSSPDLASPEKSAHLLSPILAGPSFWTLSHQQLSSTSFKDEDKTAKLHHSFASRGPVSSDVEENDSLNLLGILPNNSDSAKKNISHISSSHWGEFSTQNVDQFIPLSCSGFQSTKDFPQEPEAKNSISVLLREVKRAIARLHEDLSTVIQELNVINNILMSMSLNSSQISQSSQVPQSSEGSSDQI

SEQ ID NO: 11926 - protein, 301 aa, Homo sapiens
MQASADQVERDILETQKRLQQDRLNSEQSQALQHQQETGSSLKEAEVLLKDLFLDVDKARRLKHPQAEETEKDIEQLHERVTQECAEYCALYEKMVLPPRRGIQGRLGTRAGAETEAGLRRPVWAGHGGAGGTDRGAQHRAEGDQRPRRAAAEPGGAGCRHHPEPIPRPTEGGVVARAEPGQPVHALQGCTWQLSALAEQQRRILQQDWSDLMADPAGVRREYEHFKQHELLSQEQSVNQLEEDGKRMVELRHPAVGPIQAHQEALKMEWQNFLNLCICQETQLQHVEDYSRILCPSSSPH

SEQ ID NO: 11927 - protein, 345 aa, Homo sapiens
MQHVSSSQSSQRHVQWPGACPGAGEEQPACSQPSLPLTLPSPSHQLQQLMDGSGLTQIAQGAQVQLQHPGTPITVRERRPSQPHTQSGGTIHHLGPQSPAAAGGAGLQPLASPSHITTANLPPQPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQPLAPTTVLSVSADWNALLQRPNKYIWGLQYLEM

SEQ ID NO: 11928 - protein, 488 aa, Homo sapiens
MQHVSSSQSSQRHVQWPGACPGAGEEQPACSQPSLPLTLPSPSHQLQQLMVRGGPAGGQNMNVDLQGVGPGLQGSPQVTLAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQQIHMGTPVPGDVNSIKMEASKRQ

SEQ ID NO: 11929 - protein, 419 aa, Homo sapiens [sequence omitted]

SEQ ID NO: 11930 - protein, 356 aa, Homo sapiens
MQHVSSSQSSQRHVQWPGACPGAGEEQPACSQPSLPLTLPSPSHQLQQLMDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQVLSDGSTVQLPRLSSLGFEDSMC

SEQ ID NO: 11931 - protein, 217 aa, Homo sapiens
MQHVSSSQSSQRHVQWPGACPGAGEEQPACSQPSLPLTLPSPSHQLQQLMDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPE

SEQ ID NO: 11932 - protein, 356 aa, Homo sapiens; identical to SEQ ID NO: 11930

SEQ ID NO: 11933 - protein, 223 aa, Homo sapiens
MQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLP

SEQ ID NO: 11934 - protein, 156 aa, Homo sapiens
MQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHH

SEQ ID NO: 11935 - protein, 1130 aa, Homo sapiens
MQFPSPPAARSSPAPQAASSSEAAAPATGQPGPSCPVPGTSRRGRPGTPPAGRVEEEEEEEEEDVDKDPHPTQNTCLRCRHFSLRERKREPRRTMGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDAPSLIGVVRKDWASQNSIALSWQAPAFSNGAILDYEIKYYEKEHEQLTYSSTRSKAPSVIITGLKPATKYVFHIRVRTATGYSGYSQKFEFETGDETSDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPASLHQLMLHCWQKERNHRPKFTDIVSFLDKLIRNPSALHTLVEDILVMPESPGEVPEYPLFVTVGDWLDSIKMGQYKNNFVAAGFTTFDLISRMSIDDIRRIGVILIGHQRRIVSSIQTLRLHMMHIQEKGFHV

SEQ ID NO: 11936 - protein, 241 aa, Homo sapiens
MAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRLYPKAEYNGKQCSRYSI

SEQ ID NO: 11937 - protein, 334 aa, Homo sapiens
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTDLFQTLTLNLCYSA

SEQ ID NO: 11938 - protein, 285 aa, Homo sapiens
MGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHGASKGRCF

SEQ ID NO: 11939 - protein, 2420 aa, Homo sapiens
MSGHTLPPLPVPGTNSTEQASVPRAMAATLGAGTPPRPQARSIAGVYVEASGQAQSVYAAMEQGLLPAGLGQALLEAQAATGGLVDLARGQLLPVSKALQQGLVGLELKEKLLAAERATTGYPDPYGGEKLALFQAIGKEVVDRALGQSWLEVQLATGGLVDPAQGVLVAPEPACHQGLLDRETWHKLSELEPGTGDLRFLDPNTLERLTYHQLLERCVRAPGSGLALLPLKITFRSMGGAVSAAELLEVGILDEQAVQGLREGRLAAVDVSARAEVRRYLEGTGSVAGVVLLPEGHKKSFFQAATEHLLPMGTALPLLEAQAATHTLVDPITGQRLWVDEAVRAGLVSPELHEQLLVAEQAVTGHHDPFSGSQIPLFQAMKKGLVDRPLALRLLDAQLATGGLVCPARRLRLPLEAALRCGCLDEDTQRQLSQAGSFSDGTHGGLRYEQLLALCVTDPETGLAFLPLSGGPRGGEPQGPPFIKYSTRQALSTATATVSVGKFRGRPVSLWELLFSEAISSEQRAMLAQQYQEGTLSVEKLAAKLSATLEQAAATARVTFSGLRDTVTPGELLKAEIIDQDLYERLEHGQATAKDVGSLASVQRYLQGTGCIAGLLLPGSQERLSIYEARCKGLLRPGTALILLEAQAATGFIIDPKANKGHSVEEALRAAVIGPDVFAKLLSAERAVTGYTDPYTGQQISLFQAMQKGLIVREHGIRLLEAQIATGGVIDPVHSHRVPVDVAYRRGYFDQMLNLILLDPSDDTKGFFDPNTHENLTYLQLLERCVRDPETGLYLLPLSSTQSPLVDSATQQAFQNLLLSVKYGRFQGQRVSAWELINSEYFSEGRRRQLLRRYRQREVTLGQVAKLLEAETQRQADIMLPALRSRVTVHQLLEAGIIDQQLLDQVLAGTISPEALLLMDGVRRYLCGLGAVGGVRLLPSGQRLSLYQAMRQKLLGPRVALALLEAQAATGTIMDPHSPESLSVDEAVRRGVVGPELYGRLKRAEGAIAGFRDPFSGKQVSVFQAMKKGLIPWEQAARLLEAQVATGGIIDPTSHHHLPMPVAIQRGYVDQEMETALSSSSETFPTPDGQGRTSYAQLLEECPRDETSGLHLLPLPESAPALPTEEQVQRSLQAVPGAKDGTSLWDLLSSCHFTEEQRRGLLEDVQEGRTTVPQLLASVQRWVQETKLLAQARVMVPGPRGEVPAVWLLDAGIITQETLEALAQGTQSPAQVAEQPAVKACLWGTGCVAGVLLQPSGAKASIAQAVRDGLLPTGLGQRLLEAQVASGFLVDPLNNQRLSVEDAVKVGLVGRELSEQLGQAERAAAGYPDPYSRASLSLWQAMEKGLVPQNEGLPLLQVQLATGGVVDPVHGVHLPQAAACRLGLLDTQTSQVLTAVDKDNKFFFDPSARDQVTYQQLRERCVCDSETGLLLLPLPSDTVLEVDDHTAVALRAMKVPVSTGRFKGCSVSLWDLLLSEYVGADKRRELVALCRSGRAAALRQVVSAVTTLVEAAERQPLQATFRGLRKQVSARDLFRAQLISRKTLDELSQGTTTVKEVAEMDSVKRSLEGGNFIAGVLIQGTQERMSIPEALRRHILRPGTALVLLEAQAATGFIIDPVENRKLTVEEAFKAGMFGKETYVKLLSAERAVTGYTDPYTGQQISLFQAMQKDLIVREHGIRLLEAQIATGGIIDPVHSHRVPVDVAYRCGYFDEEMNRILADPSDDTKGFFDPNTHENLTYLQLLERCVEDPETGLYLLQIIKKGENYVYINEATRHVLQSRTAKMRVGRFADQVVSFWDLLSSPYFTEDRKRELIQEYGAQSGGLEKLLEIITTTIEETETQNQGIKVAAIRGEVTAADLFNSRVIDQKTLHTLRVGRTGGQALSTLECVKPYLEGSGCIAGVTVPSTREVMSLHEASRKELIPAAFATWLLEAQAATGFLLDPCTRQKLSVDEAVDVGLVNEELRERLLKAERAATGYRDPATGDTIPLFQAMQKQLIEKAEALRLLEVQVATGGVIDPQHHHRLPLETAYRRGCLHKDIYALISDQKHMRKRFVDPNTQEKVSYRELQERCRPQEDTGWLLFPVNKAARDSEHIDDETRRALEAEQVEITVGRFRGQKPTLWALLNSEYVTEEKKLQLVRMYRTHTRRALQTVAQLILELIEKQETSNKHLWFQGIRRQITASELLSSAIITEEMLQDLETGRSTTQELMEDDRVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 11940 - protein, 5088 aa, Homo sapiens
MSGHTLPPLPVPGTNSTEQASVPRAMAATLGAGTPPRPQARSIAGVYVEASGQAQSVYAAMEQGLLPAGLGQALLEAQAATGGLVDLARGQLLPVSKALQQGLVGLELKEKLLAAERATTGYPDPYGGEKLALFQAIGKEVVDRALGQSWLEVQLATGGLVDPAQGVLVAPEPACHQGLLDRETWHKLSELEPGTGDLRFLDPNTLERLTYHQLLERCVRAPGSGLALLPLKITFRSMGGAVSAAELLEVGILDEQAVQGLREGRLAAVDVSARAEVRRYLEGTGSVAGVVLLPEGHKKSFFQAATEHLLPMGTALPLLEAQAATHTLVDPITGQRLWVDEAVRAGLVSPELHEQLLVAEQAVTGHHDPFSGSQIPLFQAMKKGLVDRPLALRLLDAQLATGGLVCPARRLRLPLEAALRCGCLDEDTQRQLSQAGSFSDGTHGGLRYEQLLALCVTDPETGLAFLPLSGGPRGGEPQGPPFIKYSTRQALSTATATVSVGKFRGRPVSLWELLFSEAISSEQRAMLAQQYQEGTLSVEKLAAKLSATLEQAAATARVTFSGLRDTVTPGELLKAEIIDQDLYERLEHGQATAKDVGSLASVQRYLQGTGCIAGLLLPGSQERLSIYEARCKGLLRPGTALILLEAQAATGFIIDPKANKGHSVEEALRAAVIGPDVFAKLLSAERAVTGYTDPYTGQQISLFQAMQKGLIVREHGIRLLEAQIATGGVIDPVHSHRVPVDVAYRRGYFDQMLNLILLDPSDDTKGFFDPNTHENLTYLQLLERCVRDPETGLYLLPLSSTQSPLVDSATQQAFQNLLLSVKYGRFQGQRVSAWELINSEYFSEGRRRQLLRRYRQREVTLGQVAKLLEAETQRQADIMLPALRSRVTVHQLLEAGIIDQQLLDQVLAGTISPEALLLMDGVRRYLCGLGAVGGVRLLPSGQRLSLYQAMRQKLLGPRVALALLEAQAATGTIMDPHSPESLSVDEAVRRGVVGPELYGRLKRAEGAIAGFRDPFSGKQVSVFQAMKKGLIPWEQAARLLEAQVATGGIIDPTSHHHLPMPVAIQRGYVDQEMETALSSSSETFPTPDGQGRTSYAQLLEECPRDETSGLHLLPLPESAPALPTEEQVQRSLQAVPGAKDGTSLWDLLSSCHFTEEQRRGLLEDVQEGRTTVPQLLASVQRWVQETKLLAQARVMVPGPRGEVPAVWLLDAGIITQETLEALAQGTQSPAQVAEQPAVKACLWGTGCVAGVLLQPSGAKASIAQAVRDGLLPTGLGQRLLEAQVASGFLVDPLNNQRLSVEDAVKVGLVGRELSEQLGQAERAAAGYPDPYSRASLSLWQAMEKGLVPQNEGLPLLQVQLATGGVVDPVHGVHLPQAAACRLGLLDTQTSQVLTAVDKDNKFFFDPSARDQVTYQQLRERCVCDSETGLLLLPLPSDTVLEVDDHTAVALRAMKVPVSTGRFKGCSVSLWDLLLSEYVGADKRRELVALCRSGRAAALRQVVSAVTTLVEAAERQPLQATFRGLRKQVSARDLFRAQLISRKTLDELSQGTTTVKEVAEMDSVKRSLEGGNFIAGVLIQGTQERMSIPEALRRHILRPGTALVLLEAQAATGFIIDPVENRKLTVEEAFKAGMFGKETYVKLLSAERAVTGYTDPYTGQQISLFQAMQKDLIVREHGIRLLEAQIATGGIIDPVHSHRVPVDVAYRCGYFDEEMNRILADPSDDTKGFFDPNTHENLTYLQLLERCVEDPETGLYLLQIIKKGENYVYINEATRHVLQSRTAKMRVGRFADQVVSFWDLLSSPYFTEDRKRELIQEYGAQSGGLEKLLEIITTTIEETETQNQGIKVAAIRGEVTAADLFNSRVIDQKTLHTLRVGRTGGQALSTLECVKPYLEGSGCIAGVTVPSTREVMSLHEASRKELIPAAFATWLLEAQAATGFLLDPCTRQKLSVDEAVDVGLVNEELRERLLKAERAATGYRDPATGDTIPLFQAMQKQLIEKAEALRLLEVQVATGGVIDPQHHHRLPLETAYRRGCLHKDIYALISDQKHMRKRFVDPNTQEKVSYRELQERCRPQEDTGWLLFPVNKAARDSEHIDDETRRALEAEQVEITVGRFRGQKPTLWALLNSEYVTEEKKLQLVRMYRTHTRRALQTVAQLILELIEKQETSNKHLWFQGIRRQITASELLSSAIITEEMLQDLETGRSTTQELMEDDRVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYQRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAAARRQEQTLRDATMEVQRGQFQGRPVSVWDVLFSSYLSEARRDELLAQHAAGALGLPDLVAVLTRVIEETEERLSKVSFRGLRCQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGHQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLAHPSDDTKGFFDPNTHENLTYVQLLRRCVPDPDTGLYMLQLAGRGSAVHQLSEELRCALRDARVMPGSGALQGQSVSVWELLFYREVSEDRRQDLLSRYRAGTLTVEELGATLTSLLAQAQAQARAEAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAARRQEQTLRDATMEVQRGQFQGRPVSVWDVLFSSYLSEAHRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 11941 - protein, 904 aa, Homo sapiens
MESFHTRFSAWTPFSNKSLNRQLFQERVALISHWFDLWTNKQRQEFLFAIFLRCTKSQLRFVQDWFSERMQVAKVDFSTVLPRFISLYIFSFLSPKDLCAAAQVSWPWKFLTEQDCLWMPKCVKFGWFLPYTPTDNEYGAWKRHYIACVSHLDWLTPREAAATYGTLNEPKTEDEELLERQREKCLRKRIWEKIALRKKELFKVRPPWVSGTCCSSVLKPRCQPRLSQTVRERVGLHEALEKQLVLTSLETLPKRSNISGSHSYPLLSKKNWHGVHKNDDRSSYALRPHFMLISSRIPAYEMVMESVKAGVVSVVYEHSVTLESLLYLIEKALDGQKAQSIGIFSDGDSREINLLQGYKIGVKNLLRPEVRDFWEKLGSYVATEEEGGHVDFFVPLGASEAGIEVLSQLSQLTGTFFTAPTGIATGSYQHILSDWLGSQWGKAPSSIYFCESKLQTWSSFTDFLEETLKTVRKQLYPFFKELQKSISGRMIGQFMFDTMGMTNILNNQDTAQALADGLMELSKEDSERNVVEDNSWDTKSRLSKNDLNFEALINLERILQKDSAEKRARVVRELLQSERKYVQILEIVRDVYVAPLKAALSSNRAILSAANIQIIFCDILQILSLNRQFLDNLRDRLQEWGPAHCVGEIVTKFGSQLNTYTNFFNNYPVILKTIEKCREMIPAFRTFLKRHDKTIVTKMLSLPELLLYPSRRFEEYLNLLYAVRLHTPAEHVDRGDLTTAIDQIKKYKGYIDQMKQNITMKDHLSDIQRIIWGCPTLSEVNRYLIRVQDVAQLHCCDEEISFSLRLYEHIHDLSLFLFNDALLVSSRGTSHTPFERTSKTTYQFIASVALHRLLIENIPDSKYVKNAFILQGPKYKWICATEIEDDKFLWLSVLRNAIKSSMEK

SEQ ID NO: 11942 - protein, 77 aa, Homo sapiens
MESFHTRFSAWTPFSNKSLNRQLFQERVALISHWFDLWTNKQRQEFLFAIFLRCTKSQLRFVQDWFSERMQVAKVDF

SEQ ID NO: 11943 - protein, 904 aa, Homo sapiens; identical to SEQ ID NO: 11941

SEQ ID NO: 11944 - protein, 758 aa, Homo sapiens
MQVAKVDFSTVLPRFISLYIFSFLSPKDLCAAAQVSWPWKFLTEQDCLWMPKCVKFGWFLPYTPTDNEYGAWKRHYIACVSHLDWLTPREAAATYGTLNEPKTEDEELLERQREKCLRKRIWEKIALRKKELFKVRPPWVSGTCCSSVLKPRCQPRLSQTVRERVGLHEALEKQLVLTSLETLPKRSNISGSHSYPLLSKKNWHGVHKNDDRSSYALRPHFMLISSRIPAYEMVMESVKAGVVSVVYEHSVTLESLLYLIEKALDGQKAQSIGIFSDGDSREINLLQGYKIGVKNLLRPEVRDFWEKLGSYVATEEEGGHVDFFVPLGASEAGIEVLSQLSQLTGTFFTAPTGIATGSYQHILSDWLGSQWGKAPSSIYFCESKLQTWSSFTDFLEETLKTVRKQLYPFFKELQKSISGRMIGQFMFDTMGMTNILNNQDTAQALADGLMELSKEDSERNVVEDNSWDTKSRLSKNDLNFEALINLERILQKDSAEKRARVVRELLQSERKYVQILEIVRDVYVAPLKAALSSNRAILSAANIQIIFCDILQILSLNRQFLDNLRDRLQEWGPAHCVGEIVTKFGSQLNTYTNFFNNYPVILKTIEKMKQNITMKDHLSDIQRIIWGCPTLSEVNRYLIRVQDVAQLHCCDEEISFSLRLYEHIHDLSLFLFNDALLVSSRGTSHTPFERTSKTTYQFIASVALHRLLIENIPDSKYVKNAFILQGPKYKWICATEIEDDKFLWLSVLRNAIKSSMEK

SEQ ID NO: 11945 - protein, 328 aa, Homo sapiens
MATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKGPFLLPSWTWNSDLASGDQHAFLQQEFGCGTYRTLLQKPNMSKQEKGNILWLTMVWLSLACLQRKNYNDCMLNTASQTVTTEKF

SEQ ID NO: 11946 - protein, 691 aa, Homo sapiens
MATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKVPTKKNFSILARNLNTIQVEEMSACNISIQGPSIYNKEPKNIINPHEKVQMKSICANSPIKAQQDQLQVKNNIKASLHNVKSSLPLFNTKSSTSVGQLQSPTLNSPIYMQKQGKNEHLAFNTKSKASTVGSELVLVSTTVPTVHHVSDLEMSSTLDCLPVLADWEDVVLLPASQPEENVDCTVPISDSDLEISFNSGERLMVLKELEMSSHENFGDIEETPQKSETSKSIVYKSPHTTIYNVKEAKDPGSDISAFKLPEHKSSTFNRVNANMSHPLVLGKHPLLSGGTKRNPCSPQAFPPAKKQPFTIHEEKPTSSDCSPVRSSSWRRLPSILTSTVNLQEPWKSGKMTPPLCKCGRRSKRLVVSNNGPNHGKVFYCCPIGKYQENRKCCGYFKWEQTLQKERANSMVPSHSTGGLTFSSPETSHICDRNLSISTKNSLRLRPSMRN

SEQ ID NO: 11947 - protein, 426 aa, Homo sapiens
MSACNISIQGPSIYNKEPKNIINPHEKVQMKSICANSPIKAQQDQLQVKNNIKASLHNVKSSLPLFNTKSSTSVGQLQSPTLNSPIYMQKQGKNEHLAFNTKSKASTVGSELVLVSTTVPTVHHVSDLEMSSTLDCLPVLADWEDVVLLPASQPEENVDCTVPISDSDLEISFNSGERLMVLKELEMSSHENFGDIEETPQKSETSKSIVYKSPHTTIYNVKEAKDPGSDISAFKLPEHKSSTFNRVNANMSHPLVLGKHPLLSGGTKRNPCSPQAFPPAKKQPFTIHEEKPTSSDCSPVRSSSWRRLPSILTSTVNLQEPWKSGKMTPPLCKCGRRSKRLVVSNNGPNHGKVFYCCPIGKYQENRKCCGYFKWEQTLQKERANSMVPSHSTGGLTFSSPETSHICDRNLSISTKNSLRLRPSMRN

SEQ ID NO: 11948 - protein, 231 aa, Homo sapiens
MVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKGSSPGTASGTSCYQSEEAQRKENTPGVKAYSFAMGCWPKNGLLDMNKGLSLQHIGRPHSGIDDCKNIANIMKTLAYRGFIFKQTSKPF

SEQ ID NO: 11949 - protein, 337 aa, Homo sapiens
MATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 11950 - protein, 222 aa, Homo sapiens
MFVMLQVPWLQSCANLVQIGAPLPLLGCLGQYFEVLGSMEVLAGQYGMEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 11951 - protein, 219 aa, Homo sapiens
MATASPAADGGRGRPWEGGLVSWPPAPPLTLPWTWMGPSWGQHPGEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 11952 - protein, 176 aa, Homo sapiens
MATASPAADGGRGRPWEGGLVSWPPAPPLTLPWTWMGPSWGQHPGEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDM

SEQ ID NO: 11953 - protein, 204 aa, Homo sapiens
LQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKGSSPGTASGTSCYQSEEAQRKENTPGVKAYSFAMGCWPKNGLLDMNKGLSLQHIGRPHSGIDDCKNIANIMKTLAYRGFIFKQTSKPF

SEQ ID NO: 11954 - protein, 250 aa, Homo sapiens
MATASPAADGGRGRPWEGGLVSWPPAPPLTLPWTWMGPSWGQHPGHWGFPALTEPSASPAAGLGIFEVRRDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKV

SEQ ID NO: 11955 - protein, 160 aa, Homo sapiens
MEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 11956 - protein, 1005 aa, Homo sapiens
MEKQRALVAAKDGDVATLERLLEAGALGPGITDALGAGLVHHATRAGHLDCVKFLVQRAQLPGNQRAHNGATPAHDAAATGSLAELCWLVREGGCGLQDQDASGVSPLHLAARFGHPVLVEWLLHEGHSATLETREGARPLHHAAVSGDLTCLKLLTAAHGSSVNRRTRSGASPLYLACQEGHLHLAQFLVKDCGADVHLRALDGMSALHAAAARGHYSLVVWLVTFTDIGLTARDNEGATALHFAARGGHTPILDRLLLMGTPILRDSWGGTPLHDAAENGQMECCQTLVSHHVDPSLRDEDGYTAADLAEYHGHRDCAQYLREVAQPVPLLMTPPPPPFPPPPLLATRRSLEDGRRGGPGPGNPSPMSLSPAWPGHPDQPLPREQMTSPAPPRIITSATADPEGTETALAGDTSDGLAALQLDGLPSGDIDGLVPTRDERGQPIPEWKRQVMVRKLQARLGAESSAEAQDNGGSSGPTEQAAWRYSQTHQAILGPFGELLTEDDLVYLEKQIADLQLRRRCQEYESELGRLAAELQALLPEPLVSITVNSHFLPRAPGLEVEEASIPAAEPAGSAEASEVAPGVQPLPFWCSHISRLVRSLSLLLKGVHGLVQGDEKPSTRPLQDTCREASASPPRSEAQRQIQEWGVSVRTLRGNFESASGPLCGFNPGPCEPGAQHRQCLSGCWPALPKPRSGLASGEPRPGDTEEASDSGISCEEVPSEAGAAAGPDLASLRKERIIMLFLSHWRRSAYTPALKTVACRTLGARHAGLRGQEAARSPGPPSPPSEGPRLGHLWQQRSTITHLLGNWKAIMAHVPARQLRRLSRQPRGALSPEQFLPHVDGAPVPYSSLSLDLFMLGYFQLLECDLPAEERKLRHLLCFEVFEHLGTHGWEAVRAFHKAVTDEVAAGRRAWTDGFEDIKARFFGSSQRPAWDTEPGRKSGLTLLGPLPHAAVPCSGPEPTAQRLGSRSQQGSFNGEDICGYINRSFAFWKEKEAEMFNFGE

SEQ ID NO: 11957 - protein, 961 aa, Homo sapiens
MEKQRALVAAKDGDVATLERLLEAGALGPGITDALGAGLVHHATRAGHLDCVKFLVQRAQLPGNQRAHNGATPAHDAAATGSLAELCWLVREGGCGLQDQDASGVSPLHLAARFGHPVLVEWLLHEGHSATLETREGARPLHHAAVSGDLTCLKLLTAAHGSSVNRRTRSGASPLYLACQEGHLHLAQFLVKDCGADVHLRALDGMSALHAAAARGHYSLVVWLVTFTDIGLTARDNEGATALHFAARGGHTPILDRLLLMGTPILRDSWGGTPLHDAAENGQMEVPLLMTPPPPPFPPPPLLATRRSLEDGRRGGPGPGNPSPMSLSPAWPGHPDQPLPREQMTSPAPPRIITSATADPEGTETALAGDTSDGLAALQLDGLPSGDIDGLVPTRDERGQPIPEWKRQVMVRKLQARLGAESSAEAQDNGGSSGPTEQAAWRYSQTHQAILGPFGELLTEDDLVYLEKQIADLQLRRRCQEYESELGRLAAELQALLPEPLVSITVNSHFLPRAPGLEVEEASIPAAEPAGSAEASEVAPGVQPLPFWCSHISRLVRSLSLLLKGVHGLVQGDEKPSTRPLQDTCREASASPPRSEAQRQIQEWGVSVRTLRGNFESASGPLCGFNPGPCEPGAQHRQCLSGCWPALPKPRSGLASGEPRPGDTEEASDSGISCEEVPSEAGAAAGPDLASLRKERIIMLFLSHWRRSAYTPALKTVACRTLGARHAGLRGQEAARSPGPPSPPSEGPRLGHLWQQRSTITHLLGNWKAIMAHVPARQLRRLSRQPRGALSPEQFLPHVDGAPVPYSSLSLDLFMLGYFQLLECDLPAEERKLRHLLCFEVFEHLGTHGWEAVRAFHKAVTDEVAAGRRAWTDGFEDIKARFFGSSQRPAWDTEPGRKSGLTLLGPLPHAAVPCSGPEPTAQRLGSRSQQGSFNGEDICGYINRSFAFWKEKEAEMFNFGE

SEQ ID NO: 11958 - protein, 637 aa, Homo sapiens
MSLSPAWPGHPDQPLPREQMTSPAPPRIITSATADPEGTETALAGDTSDGLAALQLDGLPSGDIDGLVPTRDERGQPIPEWKRQVMVRKLQARLGAESSAEAQDNGGSSGPTEQAAWRYSQTHQAILGPFGELLTEDDLVYLEKQIADLQLRRRCQEYESELGRLAAELQALLPEPLVSITVNSHFLPRAPGLEVEEASIPAAEPAGSAEASEVAPGVQPLPFWCSHISRLVRSLSLLLKGVHGLVQGDEKPSTRPLQDTCREASASPPRSEAQRQIQEWGVSVRTLRGNFESASGPLCGFNPGPCEPGAQHRQCLSGCWPALPKPRSGLASGEPRPGDTEEASDSGISCEEVPSEAGAAAGPDLASLRKERIIMLFLSHWRRSAYTPALKTVACRTLGARHAGLRGQEAARSPGPPSPPSEGPRLGHLWQQRSTITHLLGNWKAIMAHVPARQLRRLSRQPRGALSPEQFLPHVDGAPVPYSSLSLDLFMLGYFQLLECDLPAEERKLRHLLCFEVFEHLGTHGWEAVRAFHKAVTDEVAAGRRAWTDGFEDIKARFFGSSQRPAWDTEPGRKSGLTLLGPLPHAAVPCSGPEPTAQRLGSRSQQGSFNGEDICGYINRSFAFWKEKEAEMFNFGE

SEQ ID NO: 11959 - protein, 82 aa, Homo sapiens
MSLSPAWPGHPDQPLPREQMTSPAPPRIITSATADPEGTETALAGDTSDGLAALQLDGLPSGDIDGLVPTRDERGQPIPEWK

SEQ ID NO: 11960 - protein, 397 aa, Homo sapiens
  MOD_RES (387)..(387): Selenocysteine
MAGYEYVSPEQLAGFDKYKYSAVDTNPLSLYVMHPFWNTIVKVFPTWLAPNLITFSGFLLVVFNFLLMAYFDPDFYASAPGHKHVPDWVWIVVGILNFVAYTLDGVDGKQARRTNSSTPLGELFDHGLDSWSCVYFVVTVYSIFGRGSTGVSVFVLYLLLWVVLFSFILSHWEKYNTGILFLPWGYDISQVTISFVYIVTAVVGVEAWYEPFLFNFLYRDLFTAMIIGCALCVTLPMSLLNFFRSYKNNTLKLNSVYEAMVPLFSPCLLFILSTAWILWSPSDILELHPRVFYFMVGTAFANSTCQLIVCQMSSTRCPTLNWLLVPLFLVVLVVNLGVASYVESILLYTLTTAFTLAHIHYGVRVVKQLSSHFQIYPFSLRKPNSDCLGMEEKNIGL

SEQ ID NO: 11961 - protein, 118 aa, Homo sapiens
MHPFWNTIVKVFPTWLAPNLITFSGFLLVVFNFLLMAYFDPDFYASAPGHKHVPDWVWIVVGILNFVAYTLDGVDGKQARRTNSSTPLGELFDHGLDSWSCVYFVVTVYSIFGRGSTG

SEQ ID NO: 11962 - protein, 113 aa, Homo sapiens
MSTIQNLQSFDPFADATKGDDLLPAGTEDYIHIRIQQRNGRKTLTTVQGIADDYDKKKLVKAFKKKFACNGTVIEHPEYGEVIQLQGDQRKNICQFLLEVGIVKEEQLKVHGF

SEQ ID NO: 11963 - protein, 914 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 11964 - protein, 914 aa, Homo sapiens; identical to SEQ ID NO: 11963

SEQ ID NO: 11965 - protein, 914 aa, Homo sapiens; identical to SEQ ID NO: 11963

SEQ ID NO: 11966 - protein, 762 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKHDRKSKRLDEEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 11967 - protein, 899 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 11968 - protein, 242 aa, Homo sapiens
MLAVEVSEAEGGIREWEEEEKEEEAAERTPTGEKSPNSPRTLLSLRGKARTGGPMEVKLELHPLQNRWALWFFKNDRSRAWQDNLHLVTKVDTVEDFWALYSHIQLASKLSSGCDYALFKDGIQPMWEDSRNKRGGRWLVSLAKQQRHIELDRLWLETLLCLIGESFEEHSREVCGAVVNIRTKGDKIAVWTREAENQAGVLHVGRVYKERLGLSPKTIIGYQAHADTATKSNSLAKNKFVV

SEQ ID NO: 11969 - protein, 242 aa, Homo sapiens; identical to SEQ ID NO: 11968

SEQ ID NO: 11970 - protein, 90 aa, Homo sapiens
MLAVEVSEAEGGIREWEEEEKEEEAAERTPTGEKSPNSPRTLLSLRGKARTGGPMEVKLELHPLQNRWALWFFKNDRSRAWQDNLHLVTK

SEQ ID NO: 11971 - protein, 924 aa, Homo sapiens
MSRSRQPPLVTGISPNEGIPWTKVTIRGENLGTGPTDLIGLTICGHNCLLTAEWMSASKIVCRVGQAKNDKGDIIVTTKSGGRGTSTVSFKLLKPEKIGILDQSAVWVDEMNYYDMRTDRNKGIPPLSLRPANPLGIEIEKSKFSQKDLEMLFHGMSADFTSENFSAAWYLIENHSNTSFEQLKMAVTNLKRQANKKSEGSLAYVKGGLSTFFEAQDALSAIHQKLEADGTEKVEGSMTQKLENVLNRASNTADTLFQEVLGRKDKADSTRNALNVLQRFKFLFNLPLNIERNIQKGDYDVVINDYEKAKSLFGKTEVQVFKKYYAEVETRIEALRELLLDKLLETPSTLHDQKRYIRYLSDLHASGDPAWQCIGAQHKWILQLMHSCKEGYVKDLKGNPGLHSPMLDLDNDTRPSVLGHLSQTASLKRGSSFQSGRDDTWRYKTPHRVAFVEKLTKLVLSQLPNFWKLWISYVNGSLFSETAEKSGQIERSKNVRQRQNDFKKMIQEVMHSLVKLTRGALLPLSIRDGEAKQYGGWEVKCELSGQWLAHAIQTVRLTHESLTALEIPNDLLQTIQDLILDLRVRCVMATLQHTAEEIKRLAEKEDWIVDNEGLTSLPCQFEQCIVCSLQSLKGVLECKPGEASVFQQPKTQEEVCQLSINIMQVFIYCLEQLSTKPDADIDTTHLSVDVSSPDLFGSIHEDFSLTSEQRLLIVLSNCCYLERHTFLNIAEHFEKHNFQGIEKITQVSMASLKELDQRLFENYIELKADPIVGSLEPGIYAGYFDWKDCLPPTGVRNYLKEALVNIIAVHAEVFTISKELVPRVLSKVIEAVSEELSRLMQCVSSFSKNGALQARLEICALRDTVAVYLTPESKSSFKQALEALPQLSSGADKKLLEELLNKFKSSMHLQLTCFQAASSTMMKT

SEQ ID NO: 11972 - protein, 140 aa, Homo sapiens
MSRSRQPPLVTGISPNEGIPWTKVTIRGENLGTGPTDLIGLTICGHNCLLTAEWMSASKIVCRVGQAKNDKGDIIVTTKSGGRGTSTVSFKLLKPEKIGILDQSAVWVDEMNYYDMRTDRNKGIPPLSLRPANPLGIEIE

SEQ ID NO: 11973 - protein, 519 aa, Homo sapiens
MLDLDNDTRPSVLGHLSQTASLKRGSSFQSGRDDTWRYKTPHRVAFVEKLTKLVLSQLPNFWKLWISYVNGSLFSETAEKSGQIERSKNVRQRQNDFKKMIQEVMHSLVKLTRGALLPLSIRDGEAKQYGGWEVKCELSGQWLAHAIQTVRLTHESLTALEIPNDLLQTIQDLILDLRVRCVMATLQHTAEEIKRLAEKEDWIVDNEGLTSLPCQFEQCIVCSLQSLKGVLECKPGEASVFQQPKTQEEVCQLSINIMQVFIYCLEQLSTKPDADIDTTHLSVDVSSPDLFGSIHEDFSLTSEQRLLIVLSNCCYLERHTFLNIAEHFEKHNFQGIEKITQVSMASLKELDQRLFENYIELKADPIVGSLEPGIYAGYFDWKDCLPPTGVRNYLKEALVNIIAVHAEVFTISKELVPRVLSKVIEAVSEELSRLMQCVSSFSKNGALQARLEICALRDTVAVYLTPESKSSFKQALEALPQLSSGADKKLLEELLNKFKSSMHLQLTCFQAASSTMMKT

SEQ ID NO: 11974 - protein, 409 aa, Homo sapiens
MAALENGELGPLLSPGTLRGLEDECVTDVKAQTRAALLRVLQEDEEHWGSLEDQPSSLAQDVCELLEEHTERAPRISQEFGERMAHCCLGGLAEFLQSFQQRVERFHENPAVREMLPDTYISKTIALVNCGPPLRALAERLARVGPPESEPAREASASALDHVTRLCHRVVANLLFQELQPHFNKLMRRKWLSSPEALDGIVGTLGAQALALRRMQDEPYQALVAELHRRALVEYVRPLLRGRLRCSSARTRSRVAGRLREDAAQLQRLFRRLESQASWLDAVVPHLAEVMQLEDTPSIQVEVGVLVRDYPDIRQKHVAALLDIRGLRNTAARQEILAVARDLELSEEGALSPPRDRAFFADIPVPRPSFCLSLPLFLGRLPLSRLARPSLACLPRPRPPSLARPRAQR

SEQ ID NO: 11975 - protein, 409 aa, Homo sapiens; identical to SEQ ID NO: 11974

SEQ ID NO: 11976 - protein, 722 aa, Homo sapiens
MPSPQTDTPGPELQSPKEAEEPQTPAQGSRRTSSRKEPNAHRKDGTRLGLGSLRQAFSRASQRALTQVSKEDTGLFRRSSCSLFRSFRQALNDGPATGHSQATPEVPSGVMNGVSQQASTGAASEELKPEAEGKSVADLITERQLLAAFEQLLRLETLLVAEKASRTFEQDPTAFARRAMDVCLLYDGLAAEIGAIVRETLDSDGVDAAALAELARVVSAEEEAHPSPPDDGDFLRTPRRWRQHWEEAVRRSAQERVRRPGAGWAFGEAEGASGLAQLLAELGGLVRRDLQKVRQEVQPAYAAAGFPAWEVYLRAFHSAVAQRLQELARDARGCEQLYILLDWAANVYGSPDFLGAPGLALPAEPLPPLLAPDVWARLESDYTSFLEAKIASCFDSILQLEQSHWAAAEVPEVLQGLYQAPLSMDVHMLVAEHVKAAGAISAELEATTLRICTRALGLFVPRFEKAFLASEAVSEPHLGAYINACEELRTSLLSRFPGTQEELEKPLVTATCSFQKHLLQGLQRELQPLFRVVCTRDWLTQDWLHPLMDKVVTFAGHLQRVARPRAQETLQEVHRFVVREYLARALRPRERFRGMERMHGSQKMSLDAQAISDTFQGLGSEATWLDQAIQCVAEILGETYKDDIQRHLETLIRSYPDIRRDHILAILALRRLGRQRNQHLLQHTQDLLRAAAGAAGAEAPRGRVLFEEIKVPSAMAVLITCV

SEQ ID NO: 11977 - protein, 514 aa, Homo sapiens
MEDSEFLAYVELLDEVEQGSVRAKASSVSLHAERTWMEKMKVEDLNVCEPASPAPEAPATSLLNDLKYSPSEEEEVTYTVINQFQQKFGAAILHIKKQNVLSVAAEGANVCRHGKLCWLQVATNCRVYLFDIFLLGSRAFHNGLQMILEDKRILKVIHDCRWLSDCLSHQYGILLNNVFDTQVADVLQFSMETGGYLPNCITTLQESLIKHLQVAPKYLSFLEKRQKLIQENPEVWFIRPVSPSLLKILALEATYLLPLRLALLDEMMSDLTTLVDGYLNTYREGSADRLGGTEPTCMELPEELLQLKDFQKQRREKAAREYRVNAQGLLIRTVLQPKKLVTETAGKEEKVKGFLFGKNFRIDKAPSFTSQDFHGDVNLLKEESLNKQATNPQHLPPTEEGETSEDSSNKLICTKSKGSEDQRITQKEHFMTPKHEFQASLSLKEETEQLLMVENKEDLKCTKQAVSMSSFPQETRVSPSDTFYPIRKTVVSTLPPCPALEKIDSWISPFLNLP

SEQ ID NO: 11978 - protein, 572 aa, Homo sapiens
MDPSSDYHFLSQILWKRVKLTLVCGVFEGVLQHVDPNKIVVLKKVKNVETGRSVPGVKLFFGHEIVNVELLDEVEQGSVRAKASSVSLHAERTWMEKMKVEDLNVCEPASPAPEAPATSLLNDLKYSPSEEEEVTYTVINQFQQKFGAAILHIKKQNVLSVAAEGANVCRHGKLCWLQVATNCRVYLFDIFLLGSRAFHNGLQMILEDKRILKVIHDCRWLSDCLSHQYGILLNNVFDTQVADVLQFSMETGGYLPNCITTLQESLIKHLQVAPKYLSFLEKRQKLIQENPEVWFIRPVSPSLLKILALEATYLLPLRLALLDEMMSDLTTLVDGYLNTYREGSADRLGGTEPTCMELPEELLQLKDFQKQRREKAAREYRVNAQGLLIRTVLQPKKLVTETAGKEEKVKGFLFGKNFRIDKAPSFTSQDFHGDVNLLKEESLNKQATNPQHLPPTEEGETSEDSSNKLICTKSKGSEDQRITQKEHFMTPKHEFQASLSLKEETEQLLMVENKEDLKCTKQAVSMSSFPQETRVSPSDTFYPIRKTVVSTLPPCPALEKIDSWISPFLNLP

SEQ ID NO: 11979 - protein, 271 aa, Homo sapiens
MSRQNLVALTVTTLLGVAVGGFVLWKGIQRRRRSKTSPVTQQPQQKVLGSRELPPPEDDQLHSSAPRSSWKERILKAKVVTVSQEAEWDQIEPLLRSELEDFPVLGIDCEWVNLEGKASPLSLLQMASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKR

SEQ ID NO: 11980 - protein, 621 aa, Homo sapiens
MSRQNLVALTVTTLLGVAVGGFVLWKGIQRRRRSKTSPVTQQPQQKVLGSRELPPPEDDQLHSSAPRSSWKERILKAKVVTVSQEAEWDQIEPLLRSELEDFPVLGIDCEWVNLEGKASPLSLLQMASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETRISNENYVPHGLKVVQCHSQGGLRSLMQLESRWRQHFLDSMQPKHLPQQWSVDHNHQKLLRKFGEDLPIQLS

SEQ ID NO: 11981 - protein, 496 aa, Homo sapiens
MASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETRISNENYVPHGLKVVQCHSQGGLRSLMQLESRWRQHFLDSMQPKHLPQQWSVDHNHQKLLRKFGEDLPIQLS

SEQ ID NO: 11982 - protein, 621 aa, Homo sapiens; identical to SEQ ID NO: 11980

SEQ ID NO: 11983 - protein, 496 aa, Homo sapiens; identical to SEQ ID NO: 11981

SEQ ID NO: 11984 - protein, 496 aa, Homo sapiens; identical to SEQ ID NO: 11981

SEQ ID NO: 11985 - protein, 496 aa, Homo sapiens; identical to SEQ ID NO: 11981

SEQ ID NO: 11986 - protein, 114 aa, Homo sapiens
MASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQ

SEQ ID NO: 11987 - protein, 496 aa, Homo sapiens; identical to SEQ ID NO: 11981

SEQ ID NO: 11988 - protein, 876 aa, Homo sapiens
MDPGDPAGDPAAGERHRMGRDPLLLLQALQTLWSTRERKQLREEAWRGFAALDDPLAGLLDMLESCRGQRGEGPSLAAWISHQLQCWLQAQPCPSLAQHSLRLKQLQARAVKVLTESPPSLAAPLASIFQLQDADRSCLLAHVHRLHHEGRFREAATLGATLKLQSELGVEKMSIPLLLQDKVALVERYVAGFPDLQRRLLVLMDSWCQPGFDIKDVARRYPEVTSLSLEKLSPKALSRQVLRLQERYGVAPALCPNAAIQQRLAALRHLCHKRFVEKSLSQENWTDHVQGLVGQSPWLQEQLSQLLVSHSDPVTAAQCAMELLLPEERLPAAVAVELRRFRLQGRATEADSRLEVKDMKDRYYQLPIPRENVHLLASWEDLTRHEGALLQCHQVVGVDVEWTPVFVAGGRPRPSLLQVAVEGHVFLLDVLALSQPPTGQGAQAFSRLVAQLLSDPSITKLGYGMVGDLQKLGTSCPALAHVEKQILGGMDLLLVHRQMRVASVPAPAVDRARELRGLSLLVQQVLGTALDKTQQLSNWDRRPLCEEQVIYAAADAYCLLEVHQALCREPARFHLSEDLAGSRRPRHRERPGARKPPGLQKASAPAAPRQVPVAVAVSEGAAPQIPARAFRVVCDNMLQGLARSLRCLGVDARMLGNGEDHRRAAEVARQEGRIILTSGQPFHKLRAQVGAGRCLSVDCSLKAQQQAKAVLKHFNVRVTHADIFSRCQACNCDQYLKVSRDMMKQLMWLSSHQEGPRSSGDEATQSQAVQEPGPAPDAAPEGCTYDRPCRWLQMADLRAETPDMLADGTRLQLAGVPVGVLRTPGLRCFYCCTGCGKVFWDGSHLGRVATHFRDMLESAPSPCEPSPAPSPASSPF

SEQ ID NO: 11989 - protein, 514 aa, Homo sapiens
MELLLPEERLPAAVAVELRRFRLQGRATEADSRLEVKDMKDRYYQLPIPRENVHLLASWEDLTRHEGALLQCHQVVGVDVEWTPVFVAGGRPRPSLLQVAVEGHVFLLDVLALSQPPTGQGAQAFSRLVAQLLSDPSITKLGYGMVGDLQKLGTSCPALAHVEKQILGGMDLLLVHRQMRVASVPAPAVDRARELRGLSLLVQQVLGTALDKTQQLSNWDRRPLCEEQVIYAAADAYCLLEVHQALCREPARFHLSEDLAGSRRPRHRERPGARKPPGLQKASAPAAPRQGLARSLRCLGVDARMLGNGEDHRRAAEVARQEGRIILTSGQPFHKLRAQVGAGRCLSVDCSLKAQQQAKAVLKHFNVRVTHADIFSRCQACNCDQYLKVSRDMMKQLMWLSSHQEGPRSSGPAPDAAPEGCTYDRPCRWLQMADLRAETPDMLADGTRLQLAGVPVGVLRTPGLRCFYCCTGCGKVFWDGSHLGRVATHFRDMLESAPSPCEPSPAPSPASSPF

SEQ ID NO: 11990 - protein, 893 aa, Homo sapiens
MTPPSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 11991 - protein, 223 aa, Homo sapiens
MPVFPPCVLQVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQKQAYRGRACLQKPHCLL

SEQ ID NO: 11992 - protein, 942 aa, Homo sapiens
MTANRDAALSSHRHPGCAQRPRTPTFASSSQRRSAFGFDDGNFPGLGERSHAPGSRLGARRRAKTARGLRGHRQRGAGAGLSRPGSARAPSPPRPGAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSNPLEFNPDVLKKTAVQRALKSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 11993 - protein, 527 aa, Homo sapiens
MWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPATSQSRSRPPASPRTSRCPSPPRSCGKG

SEQ ID NO: 11994 - protein, 328 aa, Homo sapiens
MPVFPPCVLQVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 11995 - protein, 828 aa, Homo sapiens
MAGRGWGALWVCVAAATLLHAGGLARADCWLIEGDKGFVWLAICSQNQPPYEAIPQQINSTIVDLRLNENRIRSVQYASLSRFGNLTYLNLTKNEIGYIEDGAFSGQFNLQVLQLGYNRLRNLTEGMLRGLGKLEYLYLQANLIEVVMASSFWECPNIVNIDLSMNRIQQLNSGTFAGLAKLSVCELYSNPFYCSCELLGFLRWLAAFTNATQTYDRMQCESPPVYSGYYLLGQGRRGHRSILSKLQSVCTEDSYAAEVVGPPRPASGRSQPGRSPPPPPPPEPSDMPCADDECFSGDGTTPLVALPTLATQAEARPLIKVKQLTQNSATITVQLPSPFHRMYTLEHFNNSKASTVSRLTKAQEEIRLTNLFTLTNYTYCVVSTSAGLRHNHTCLTICLPRLPSPPGPVPSPSTATHYIMTILGCLFGMVLVLGAVYYCLRRRRRQEEKHKKAASAAAAGSLKKTIIELKYGPELEAPGLAPLSQGPLLGPEAVTRIPYLPAAGEVEQYKLVESADTPKASKGSYMEVRTGDPPERRDCELGRPGPDSQSSVAEISTIAKEVDKVNQIINNCIDALKSESTSFQGVKSGPVSVAEPPLVLLSEPLAAKHGFLAPGYKDAFGHSLQRHHSVEAAGPPRASTSSSGSVRSPRAFRAEAVGVHKAAAAEAKYIEKGSPAADAILTVTPAAAVLRAEAEKGRQYGEHRHSYPGSHPAEPPAPPGPPPPPPHEGLGRKASILEPLTRPRPRDLAYSQLSPQYHSLSYSSSPEYTCRASQSIWERFRLSRRRHKEEEEFMAAGHALRKKVQFAKDEDLHDILDYWKGVSAQHKS

SEQ ID NO: 11996 - protein, 828 aa, Homo sapiens; identical to SEQ ID NO: 11995

SEQ ID NO: 11997 - protein, 164 aa, Homo sapiens
MLQQDSNDDTEDVSLFDAEEETTNRPRKAKIRHPVASFFHLFFRVSAIIVCLLCELLSSSFITCMVTIILLLSCDFWAVKNVTGRLMVGLRWWNHIDEDGKSHWVFESRKESSQENKTVSEAESRIFWLGLIACSVLWVIFAFSALFSFTVKWLESEPVMLRNQ

SEQ ID NO: 11998 - protein, 177 aa, Homo sapiens
MSVNMDELKHQVMINQFVLTAGCAADQAKQLLQAAHWQFETALSAFFQETNIPYSHHHHQMMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 11999 - protein, 164 aa, Homo sapiens
MSVNMDELRHQVMINQFVLAAGCAADQAKQLLQAAHWQFETALSTFFQETNIPNSHHHHQMMCTPSNTPATPPNFPDALAMFSKLRASEGLQSSNSPMTAAACSPPANFSPFWASSPPSHQAPWIPPSSPTTFHHLHRPQPTWPPGAQQGGAQQKAMAAMDGQR

SEQ ID NO: 12000 - protein, 144 aa, Homo sapiens
SPASLPLAPGCALRLCPLSFGEGVEFDPLPPKEVRYTSLVKYDSERHFIDDVQLPLGLAVASCSQTVTCVPNGTWRNYKAEVRFEPRHRPTRFLSTTIVYPKYPKAVYTTTLDYNCRKTLRRFLSSVELEAAELPGSDDLSDEC

SEQ ID NO: 12001 - protein, 135 aa, Homo sapiens
MRPRMLPVFFGESIKVNPEPTHEIRCNSEVKYASEKHFQDKVFYAPVPTVTAYSETIVAAPNCTWRNYRSQLTLEPRPRALRFRSTTIIFPKHARSTFRTTLHCSLGRPSRWFTASVQLQLCQDPAPSLLGPATL

SEQ ID NO: 12002 - protein, 135 aa, Homo sapiens; identical to SEQ ID NO: 12001

SEQ ID NO: 12003 - protein, 216 aa, Homo sapiens
MVGHLHLQGMEDSLKEQGREGLLDSPDSGLPPSPSPSPPFYSLAPGILDARAGGAGASSEPPGPSEARAPPSQLPNPPASEMRPRMLPVFFGESIKVNPEPTHEIRCNSEVKYASEKHFQDKVFYAPVPTVTAYSETIVAAPNCTWRNYRSQLTLEPRPRALRFRSTTIIFPKHARSTFRTTLHCSLGRPSRWFTASVQLQLCQDPAPSLLGPATL

SEQ ID NO: 12004 - protein, 122 aa, Homo sapiens
MRPRMLPVFFGESIKVNPEPTHEIRCNSEVKYASEKHFQDKVFYAPVPTVTAYSETIVAAPNCTWRNYRSRWFTASVQLQLCQEAGREAARPRTRVEGGGSPLPALTYRLGGGLLVLVSRTQ

SEQ ID NO: 12005 - protein, 135 aa, Homo sapiens; identical to SEQ ID NO: 12001

SEQ ID NO: 12006 - protein, 144 aa, Homo sapiens; identical to SEQ ID NO: 12000

SEQ ID NO: 12007 - protein, 360 aa, Homo sapiens
MMKKKKFKFKVDFELEELSSVPFVNGVLFCKMRLLDGGSFTAESSREVVQANCVRWRKKFSFMCKMSASAATGILDPCIYRVSVRKELKGGKAYAKLGFADLNLAEFAGSGNTTRRCLLEGYDTKNTRQDNSILKVLISMQLMSGDPCFKTPPSTSMSIPIAGESESLQEDRKGGETLKVHLGIADLSAKSASVPDELGACGHSRTSSYASQQSKVSGYSTCHSRSSSFSELCHRRNTSVGSTSTGVESILEPCDEIEQKIAEPNLDTADKEDTASEKLSRCPVKQDSVESQLKRVDDTRVDADDIVEKILQSQDFSLDSSAEEEGLRLFVGPGGSTTFGSHHLPNRVGSGAYEQVVIKR

SEQ ID NO: 12008 - protein, 355 aa, Homo sapiens
MMKKKKFKFKVDFELEELSSVPFVNGVLFCKMRLLDGGSFTAESSREVVQANCVRWRKKFSFMCKMSASAATGILDPCIYRVSVRKELKGGKAYAKLGFADLNLAEFAGSGNTTRRCLLEGYDTKNTRQDNSILKVLISMQLMSGDPCFKTPPSTSMSIPIAGESESLQEDRKGGETLKVHLGIADLSAKSASVPDELGACGHSRTSSYASQQSKVSGYSTCHSRSSSFSELCHRRNTSVGSTSTGVESILEPCDEIEQKIAEPNLDTADKEDTASEKLSRCPVKQDSVESQLKRVDDTRVDADDIVEKILQSQDFSLDSSAEEEGLRLFVGPGGSTTFGSHHLPNSFLNSGSLI

SEQ ID NO: 12009 - protein, 118 aa, Homo sapiens
MTDTAEAVPKFEEMFASRFTENDKEYQEYLKRPPESPPIVEEWNSRAGGNQRNRGNRLQDNRQFRGRDNRWGWPSDNRSNQWHGRSWGNNYPQHRQEPYYPQQYGHYGYNQRPPYGYY

SEQ ID NO: 12010 - protein, 46 aa, Homo sapiens
MGGCPVRKRRRNGSKEGNHHSTQPKRNKRNPIFQDSQDTEVAIFME

SEQ ID NO: 12011 - protein, 112 aa, Homo sapiens
MTCRKRRRNGSKEGNHHSTQPKRNKRNPIFQDSQDTEFSWSDNERSSSRINIPERASGPEGNLNQIVTEPDANFPQFLHEGYVPCQGLYSHINQTLKEAHFNSLQQRGQAPT

SEQ ID NO: 12012 - protein, 114 aa, Homo sapiens
MLVLWLKRRRNGSKEGNHHSTQPKRNKRNPIFQDSQDTEFSWSDNERSSSRINIPERASGPEGNLNQIVTEPDANFPQFLHEGYVPCQGLYSHINQTLKEAHFNSLQQRGQAPT

SEQ ID NO: 12013 - protein, 186 aa, Homo sapiens
MGGRGADAGSSGGTGPTEGYSPPAASTRAAARAKARGGGRGGRRNTTPSVPSLRGAAPRSFHPPAAMSERLRPRKRRRNGNEEDNHLPPQTKRSSRNPVFQDSWDTESSGSDSGGSSSSSSSSINSPDRASGPEGSLSQTMAGSSPNTPQPVPEQSALCQGLYFHINQTLREAHFHSLQHRGRPLT

SEQ ID NO: 12014 - protein, 207 aa, Homo sapiens
MGGRGADAGSSGGTGPTEGYSPPAASTRAAARAKARGGGRGGRRNTTPSVPSLRGAAPRSFHPPAAMSERLRPRKRRRNGNEEDNHLPPQTKRSSRNPVFQDSWDTETVPVMRNSKENRLRGNKAFCASSGSDSGGSSSSSSSSINSPDRASGPEGSLSQTMAGSSPNTPQPVPEQSALCQGLYFHINQTLREAHFHSLQHRGRPLT

SEQ ID NO: 12015 - protein, 116 aa, Homo sapiens
MGGCPVRKRRRNGSKEGNHHSTQPKRNKRNPIFQDSQDTEVFSWSDNERSSSRINIPERASGPEGNLNQIVTEPDANFPQFLHEGLSKPVYVINWFMSFGPEIKLNTSQQGRNQAV

SEQ ID NO: 12016 - protein, 115 aa, Homo sapiens
MGGCPVRKRRRNGSKEGNHHSTQPKRNKRNPIFQDSQDTEFSWSDNERSSSRINIPERASGPEGNLNQIVTEPDANFPQFLHEGLSKPVYVINWFMSFGPEIKLNTSQQGRNQAV

SEQ ID NO: 12017 - protein, 116 aa, Homo sapiens
MGGCPVRKRRRNGSKEGNHHSTQPKRNKRNPIFQDSQDTEVFSWSDNERSSSRINIPERASGPEGNLNQIVTEPDANFPQFLHEGYVPCQGLYSHINQTLKEAHFNSLQQRGQAPT

SEQ ID NO: 12018 - protein, 356 aa, Homo sapiens
MAATRSPTRARERERSGAPAAGSDQVHSWMLATSQALDTVWRMAKGFVMLAVSFLVAAICYFRRLHLYSGHKLKWWIGYLQRKFKRNLSVEAEVDLLSYCAREWKGETPRNKLMRKAYEELFWRHHIKCVRQVRRDNYDALRSVLFQIFSQGISFPSWMKEKDIVKLPEKLLFSQGCNWIQQYSFGPEKYTGSNVFGKLRKYVELLKTQWTEFNGIRDYHKRGSMCNTLFSDAILEYKLYEALKFIMLYQVTEVYEQMKTKKVIPSLFRLLFSRETSSDPLSFMMNHLNSVGDTCGLEQIDMFILGYSLEVKIKVFRLFKFNSRDFEVCYPEEPLRDWPEISLLTENDRHYHIPVF

SEQ ID NO: 12019 - protein, 352 aa, Homo sapiens
MSRGTMPQPEAWPGASCAETPAREAAATARDGGKAAASGQPRPEMQCPAEHEEDMYRAADEIEKEKELLIHERGASEPRLSVAPEMDIMDYCKKEWRGNTQKATCMKMGYEEVSQKFTSIRRVRGDNYCALRATLFQAMSQAVGLPPWLQDPELMLLPEKLISKYNWIKQWKLGLKFDGKNEDLVDKIKESLTLLRKKWAGLAEMRTAEARQIACDELFTNEAEEYSLYEAVKFLMLNRAIELYNDKEKGKEVPFFSVLLFARDTSNDPGQLLRNHLNQVGHTGGLEQVEMFLLAYAVRHTIQVYRLSKYNTEEFITVYPTDPPKDWPVVTLIAEDDRHYNIPVRVCEETSL

SEQ ID NO: 12020 - protein, 169 aa, Homo sapiens
MLPSTMFLVHLPLSTNRLHCLRNTSLESYLCSFVHLNHPLHISDRVILISLHEAVRFSFAFSFPRGTLSIAYCLMSSVSTSSEAIMSTELLANYCHSSLHVCICISSFPNETGNHDSFPGAVVSISDQPTDQCKLAAKELPLRNLLECRFFDCMGEEDLINLGVIGTER

SEQ ID NO: 12021 - protein, 169 aa, Homo sapiens
MLPSTMFLVHLPLSTNRLHCLRNTSLEPCLCSFVHLNHPLHISDPVILISLHEAVRFSFAFSFPRGTLSIAYCLMSSVSTSSEAIMSTELLANYCHSSLHVCICISSFPNETGNHDSFPGAVVSISDQPTDQCKLAAKELPLRNLLECRFFDCMGEEDLINLGVIGTER

SEQ ID NO: 12022 - protein, 306 aa, Homo sapiens
MSTWKARLTKRLKSPSRSMHPFPCSALLACFGNTRESASFNQSGVADTHSTVRVQPVAKAGRQPRHPSAEGAPEKRQDSSTHAERNGSANRNSSHRTAAQPAETPEDVPGSLDDGADCEAVVFHASIPRPSIIDTPKEEEFREEPKCLELEQKMTSDSPPEDIDHKDSYLITRSIMAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 12023 - protein, 131 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 12024 - protein, 131 aa, Homo sapiens; identical to SEQ ID NO: 12023

SEQ ID NO: 12025 - protein, 131 aa, Homo sapiens; identical to SEQ ID NO: 12023

SEQ ID NO: 12026 - protein, 131 aa, Homo sapiens; identical to SEQ ID NO: 12023

SEQ ID NO: 12027 - protein, 131 aa, Homo sapiens; identical to SEQ ID NO: 12023

SEQ ID NO: 12028 - protein, 131 aa, Homo sapiens; identical to SEQ ID NO: 12023

SEQ ID NO: 12029 - protein, 90 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIELLKRQQK

SEQ ID NO: 12030 - protein, 128 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQA

SEQ ID NO: 12031 - protein, 131 aa, Homo sapiens; identical to SEQ ID NO: 12023

SEQ ID NO: 12032 - protein, 131 aa, Homo sapiens; identical to SEQ ID NO: 12023

SEQ ID NO: 12033 - protein, 67 aa, Homo sapiens
MAEPDYIEDDNPELIRPQKLINPVKTSRNHQDLHRELLMNQKRGLAPQNKPELQKVMEKRKRDQVIK

SEQ ID NO: 12034 - protein, 101 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKL

SEQ ID NO: 12035 - protein, 131 aa, Homo sapiens; identical to SEQ ID NO: 12023

SEQ ID NO: 12036 - protein, 131 aa, Homo sapiens; identical to SEQ ID NO: 12023

SEQ ID NO: 12037 - protein, 84 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIEL

SEQ ID NO: 12038 - protein, 93 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQ

SEQ ID NO: 12039 - protein, 126 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVA

SEQ ID NO: 12040 - protein, 125 aa, Homo sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEV

SEQ ID NO: 12041 - protein, 131 aa, Homo sapiens; identical to SEQ ID NO: 12023

SEQ ID NO: 12042 - protein, 329 aa, Homo sapiens
MPEPGPRMNGFSLGELCWLFCCPPCPSRIAAKLAFLPPEPTYTVLAPEQRGAGASAPAPAQATAAAAAAQPAPQQPEEGAGAGPGACSLHLSERADWQYSQRELDAVEVFFSRTARDNRLGCMFVRCAPSSRYTLLFSHGNAVDLGQMCSFYIGLGSRINCNIFSYDYSGYGVSSGKPSEKNLYADIDAAWQALRTRYGVSPENIILYGQSIGTVPTVDLASRYECAAVILHSPLMSGLRVAFPDTRKTYCFDAFPSIDKISKVTSPVLVIHGTEDEVIDFSHGLAMYERCPRAVEPLWVEGAGHNDIELYAQYLERLKQFISHELPNS

SEQ ID NO: 12043 - protein, 295 aa, Homo sapiens
MPEPGPRMNGFSLGELCWLFCCPPCPSRIAAKLAFLPPEPTYTVLAPEQRGAGASAPAPAQATAAAAAAQPAPQQPEEGAGAGPGACSLHLSERADWQYSQRELDAVEVFFSRTARDNRLGCMFVRCAPSSRYTLLFSHGNAVDLGQMCSFYIGLGSRINCNIFSYDYSGYGVSSGKPSEKNLYADIDAAWQALRTRYGVSPENIILYGQSIGTVPTVDLASSIDKISKVTSPVLVIHGTEDEVIDFSHGLAMYERCPRAVEPLWVEGAGHNDIELYAQYLERLKQFISHELPNS

SEQ ID NO: 12044 - protein, 271 aa, Homo sapiens
MLLAPPSTPSRGRTPSAVERLEADKAKYVKTHQVIARRQEPALRGSPGPLTPHPCNELGPPASPRTPRPVRRGSGRRLPRPDSLIFYRQKRDCKASVNKENAKGQGLVRRLFLGAPRDAAPSSPASTERPAASGGWAAPQDAPEAAGKRALCPTCSLPLSEKERFFNYCGLERALVEVLGAERFSPQSWGADASPQAGTSPPPGSGDASDWTSSDRGVDSPGGAGGGGGSEAAGSARDRRPPVSVVERNARVIQWLYGCQRARGPPRESEV

SEQ ID NO: 12045 - protein, 611 aa, Homo sapiens
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKLTHSENSSLYMALNTLQAVRKEIETHQGQEMLVRGTEGIKEYINLGMPLSCFPEGGQVVITFSQSKSKQKEDNHIFGRQDKASTECVKFYIHAIGIGKCKRRIVKCGKLHKKGRKLCVYAFKGETIKDALCKDGRFLSFLENDDWKLIENNDTILESTQPVDELEGRYFQVEVEKRMVPSAAASQNPESEKRNTCVLREQIVAQYPSLKRESEKIIENFKKKMKVKNGETLFELHRTTFGKVTKNSSSIKVVKLLVRLSDSVGYLFWDSATTGYATCFVFKGLFILTCRHVIDSIVGDGIEPSKWATIIGQCVRVTFGYEELKDKETNYFFVEPWFEIHNEELDYAVLKLKENGQQVPMELYNGITPVPLSGLIHIIGHPYGEKKQIDACAVIPQGQRAKKCQERVQSKKAESPEYVHMYTQRSFQKIVHNPDVITYDTEFFFGASGSPVFDSKGSLVAMHAAGFAYTYQNETRSIIEFGSTMESILLDIKQRHKPWYEEVFVNQQDVEMMSDEDL

SEQ ID NO: 12046 - protein, 611 aa, Homo sapiens; identical to SEQ ID NO: 12045

SEQ ID NO: 12047 - protein, 183 aa, Homo sapiens
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKLTHSENSSLYMALNTLQAVRKEIETHQGQEMLVRGTEGIKEYINLGMPLSCFPEGGQVVITFSQSKSKQKEDNHIFGRQDKASTECVK

SEQ ID NO: 12048 - protein, 611 aa, Homo sapiens; identical to SEQ ID NO: 12045

SEQ ID NO: 12049 - protein, 611 aa, Homo sapiens; identical to SEQ ID NO: 12045

SEQ ID NO: 12050 - protein, 96 aa, Homo sapiens
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKL

SEQ ID NO: 12051 - protein, 611 aa, Homo sapiens; identical to SEQ ID NO: 12045

SEQ ID NO: 12052 - protein, 734 aa, Homo sapiens
MNSMKTEENKSFSAMEDDQRTRPEVSKDTVMKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIGRTRKKIVKINELHEKGSKLCIYALKGETIEGALCKDGRFRSDIGEFEWKLKEGHKKIYGKQSMVDEVSGKVLEMDISKKKALQQKDIHKKIKQNESATDEINHQSLIQSKKKVHKPKKDGETKDVEHSREQILPPQDLSHYIKDKTRQTIPRIRNYYFCSLPRKYRQINSQVRRRPHLGRRYAINLDVQKEAINLLKNYQTLNEAIMHQYPNFKEEAQWVRKYFREEQKRMNLSPAKQFNIYKKDFGKMTANSVSVATCEQLTYYSKSVGFMQWDNNGNTGNATCFVFNGGYIFTCRHVVHLMVGKNTHPSLWPDIISKCAKVTFTYTEFCPTPDNWFSIEPWLKVSNENLDYAILKLKENGNAFPPGLWRQISPQPSTGLIYLIGHPEGQIKKIDGCTVIPLNERLKKYPNDCQDGLVDLYDTTSNVYCMFTQRSFLSEVWNTHTLSYDTCFSDGSSGSPVFNASGKLVALHTFGLFYQRGFNVHALIEFGYSMDSILCDIKKTNESLYKSLNDEKLETYDEEKGKQESSLQDHQIEPMEC

SEQ ID NO: 12053 - protein, 704 aa, Homo sapiens
MKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIGRTRKKIVKINELHEKGSKLCIYALKGETIEGALCKDGRFRSDIGEFEWKLKEGHKKIYGKQSMVDEVSGKVLEMDISKKKALQQKDIHKKIKQNESATDEINHQSLIQSKKKVHKPKKDGETKDVEHSREQILPPQDLSHYIKDKTRQTIPRIRNYYFCSLPRKYRQINSQVRRRPHLGRRYAINLDVQKEAINLLKNYQTLNEAIMHQYPNFKEEAQWVRKYFREEQKRMNLSPAKQFNIYKKDFGKMTANSVSVATCEQLTYYSKSVGFMQWDNNGNTGNATCFVFNGGYIFTCRHVVHLMVGKNTHPSLWPDIISKCAKVTFTYTEFCPTPDNWFSIEPWLKVSNENLDYAILKLKENGNAFPPGLWRQISPQPSTGLIYLIGHPEGQIKKIDGCTVIPLNERLKKYPNDCQDGLVDLYDTTSNVYCMFTQRSFLSEVWNTHTLSYDTCFSDGSSGSPVFNASGKLVALHTFGLFYQRGFNVHALIEFGYSMDSILCDIKKTNESLYKSLNDEKLETYDEEKGKQESSLQDHQIEPMEC

SEQ ID NO: 12054 - protein, 704 aa, Homo sapiens; identical to SEQ ID NO: 12053

SEQ ID NO: 12055 - protein, 162 aa, Homo sapiens
MKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIG

SEQ ID NO: 12056 - protein, 403 aa, Homo sapiens
MVFCLSSEEPRRPLRSDMVHFQASEVQQLLHNKFVVILGDSIQRAVYKDLVLLLQKDSLLTAAQLKAKYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 12057 - protein, 454 aa, Homo sapiens
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 12058 - protein, 154 aa, Homo sapiens
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGASPSHPMNSSTIIQWRTSRCHPT

SEQ ID NO: 12059 - protein, 280 aa, Homo sapiens
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPP

SEQ ID NO: 12060 - protein, 229 aa, Homo sapiens
MVFCLSSEEPRRPLRSDMVHFQASEVQQLLHNKFVVILGDSIQRAVYKDLVLLLQKDSLLTAAQLKAKYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPP

SEQ ID NO: 12061 - protein, 279 aa, Homo sapiens
MNSCLWDISRYGPNSWRSYLENLENLFQCLGQVLPESCLLVWNTAMPVGEEVTGGFLPPKLRRQKATFLKNEVVKANFHSATEARKHNFDVLDLHFHFRHARENLHWDGVHWNGRVHRCLSQLLLAHVADAWGVELPHRHPVGEWIKKKKPGPRVEGPPQANRNHPALPLSPPLPSPTYRPLLGFPPQTILSSRINSIAIQMSPHQPMQVSSSKTILWLVLSCLCPSSPHPVISGLPQWYIGVLAGIVPVAPIRPGDSGLDLQREGPQPILSQGLNRRT

SEQ ID NO: 12062 - protein, 432 aa, Homo sapiens
MILLRASEVRQLLHNKFVVILGDSVHRAVYKDLVLLLQKDRLLTPGQLRARGELNFEQDELVDGGQRGHMHNGLNYREVREFRSDHHLVRFYFLTRVYSDYLQTILKELQSGEHAPDLVIMNSCLWDISRYGPNSWRSYLENLENLFQCLGQVLPESCLLVWNTAMPVGEEVTGGFLPPKLRRQKATFLKNEVVKANFHSATEARKHNFDVLDLHFHFRHARENLHWDGVHWNGRVHRCLSQLLLAHVADAWGVELPHRHPVGEWIKKKKPGPRVEGPPQANRNHPALPLSPPLPSPTYRPLLGFPPQRLPLLPLLSPQPPPPILHHQGMPRFPQGPPDACFSSDHTFQSDQFYCHSDVPSSAHAGFFVEDNFMVGPQLPMPFFPTPRYQRPAPVVHRGFGRYRPRGPYTPWGQRPRPSKRRAPANPEPRPQ

SEQ ID NO: 12063 - protein, 432 aa, Homo sapiens; identical to SEQ ID NO: 12062

SEQ ID NO: 12064 - protein, 167 aa, Homo sapiens
MILLRASEVRQLLHNKFVVILGDSVHRAVYKDLVLLLQKDRLLTPGQLRARGELNFEQDELVDGGQRGHMHNGLNYREVREFRSDHHLVRFYFLTRVYSDYLQTILKELQSGEHAPDLVIMNSCLWDISRYGPNSWRSYLENLENLFQCLGQVLPESCLLVWNTAMP

SEQ ID NO: 12065 - protein, 168 aa, Homo sapiens
MILLRASEVRQLLHNKFVVILGDSVHRAVYKDLVLLLQKDRLLTPGQLRARGELNFEQDELVDGGQRGHMHNGLNYREVREFRSDHHLVRFYFLTRVYSDYLQTILKELQSGEHAPDLVIMNSCLWDISRYGPNSWRSYLENLENLFQCLGQVLPESCLLVWNTAMPV

SEQ ID NO: 12066 - protein, 58 aa, Homo sapiens
MILLRASEVRQLLHNKFVVILGDSVHRAVYKDLVLLLQKDRLLTPGQLRARGELNFEQ

SEQ ID NO: 12067 - protein, 505 aa, Homo sapiens
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSEISTEVKYVAGETNAKENENSSPVAGAFGVFSTISTAVQSTGKSVISGGLDALEFIGKKTMDVIAEGDPGFKRTKGLMNRNATLSQVLREAKEKEEIRTSNEVTVETDKKTHYGLLFDEFQGLSHLEALEMLSQESEIKVKSILNSLSGEELETLKVELEQLKETFSLAEFCEEEEEEKKGDEDFTKDITELFSQLHVSSKPEKLARARNTAHEWIRKSLTKPLAENEEGEKQSEAENTEQVNKNSIEDIHAFAIRSLAELTACSIELFHKTAALVLHGRKQEVTAIERSQTLSQMTIVLCKELSSLSKEFTTCLTTAGVKEMADVLNPLITAVFLEASNSASYIQDAFQLLLPVLEISLIENKIESHRHELQGQKPLLEH

SEQ ID NO: 12068 - protein, 249 aa, Homo sapiens [sequence omitted]

SEQ ID NO: 12069 - protein, 64 aa, Homo sapiens
MSDKDDIETPLLTEAAPILEDGNCEPAKNSESVDQGAKPESKSEPVVSTRKRPETKPSSDLETS

SEQ ID NO: 12070 - protein, 103 aa, Homo sapiens
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATV

SEQ ID NO: 12071 - protein, 125 aa, Homo sapiens
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSE

SEQ ID NO: 12072 - protein, 505 aa, Homo sapiens; identical to SEQ ID NO: 12067

SEQ ID NO: 12073 - protein, 210 aa, Homo sapiens
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSEISTEVKYVAGETNAKENENSSPVAGAFGVFSTISTAVQSTGKSVISGGLDALEFIGKKTMDVIAEGDPGFKRTKGLMNRNATLSQ

SEQ ID NO: 12074 - protein, 79 aa, Homo sapiens
MSDKDDIETPLLTEAAPILEDGNCEPAKNSESVDQGAKPESKSEPVVSTRKRPETKPSSDLETSKVLPIQDNVSKDVPQ

SEQ ID NO: 12075 - protein, 505 aa, Homo sapiens; identical to SEQ ID NO: 12067

SEQ ID NO: 12076 - protein, 166 aa, Homo sapiens
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSEISTEVKYVAGETNAKENENSSPVAGAFGVFSTISTAVQSTG

SEQ ID NO: 12077 - protein, 15 aa, Homo sapiens
MSDKDDIETPLLTEA

SEQ ID NO: 12078 - protein, 919 aa, Homo sapiens
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVLFTFPGNLVTSVAGIYFTDNKGDTSFFKVSKKMPKIPVLVSCEDDLSDDREELLHGISELDISNSDCFPSQLLVHGALAFPLGLDSYHGCVIAAARYGRGRVVVTGHKVLFTVGKLGPFLLNAVRWLDGGRRGKVVVQTELRTLSGLLAVGGIDTSIEPNLTSDASVYCFEPVSEVGVKELQEFVAEGGGLFVGAQAWWWAFKNPGVSPLARFPGNLLLNPFGISITSQSLNPGPFRTPKAGIRTYHFRSTLAEFQVIMGRKRGNVEKGWLAKLGPDGAAFLQIPAEEIPAYMSVHRLLRKLLSRYRLPVATRENPVINDCCRGAMLSLATGLAHSGSDLSLLVPEIEDMYSSPYLRPSESPITVEVNCTNPGTRYCWMSTGLYIPGRQIIEVSLPEAAASADLKIQIGCHTDDLTRASKLFRGPLVINRCCLDKPTKSITCLWGGLLYIIVPQNSKLGSVPVTVKGAVHAPYYKLGETTLEEWKRRIQENPGPWGELATDNIILTVPTANLRTLENPEPLLRLWDEVMQAVARLGAEPFPLRLPQRIVADVQISVGWMHAGYPIMCHLESVQELINEKLIRTKGLWGPVHELGRNQQRQEWEFPPHTTEATCNLWCVYVHETVLGIPRSRANIALWPPVREKRVRIYLSKGPNVKNWNAWTALETYLQLQEAFGWEPFIRLFTEYRNQTNLPTENVDKMNLWVKMFSHQVQKNLAPFFEAWAWPIQKEVATSLAYLPEWKENIMKLYLLTQM

SEQ ID NO: 12079 - protein, 167 aa, Homo sapiens
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVL

SEQ ID NO: 12080 - protein, 146 aa, Homo sapiens
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGG

SEQ ID NO: 12081 - protein, 921 aa, Homo sapiens
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVLFTFPGNLVTSVAGIYFTDNKGDTSFFKVSKKMPKIPVLVSCEDDLSDDREELLHGISELDISNSDCFPSQLLVHGALAFPLGLDSYHGCVIAAARYGRGRVVVTGHKVLFTVGKLGPFLLNAVRWLDGGRRGKVVVQTELRTLSGLLAVGGIDTSIEPNLTSDASVYCFEPVSEVGVKELQEFVAEGGGLFVGAQAWWWAFKNPGVSPLARFPGNLLLNPFGISITSQSLNPGPFRTPKAGIRTYHFRSTLAEFQVIMGRKRGNVEKGWLAKLGPDGAAFLQIPAEEIPAYMSVHRLLRKLLSRYRLPVATRENPVINDCCRGAMLSLATGLAHSGSDLSLLVPEIEDMYSSPYLRPSESPITVEVNCTNPGTRYCWMSTGLYIPGRQIIEVSLPEAAASADLKIQIGCHTDDLTRASKLFRGPLVINRCCLDKPTKSITCLWGGLLYIIVPQNSKLGSVPVTVKGAVHAPYYKLGETTLEEWKRRIQENPGPWGELATDNIILTVPTANLRTLENPEPLLRLWDEVMQAVARLGAEPFPLRLPQRIVADVQISVGWMHAGYPIMCHLESVQELINEKLIRTKGLWGPVHELGRNQQRQEWEFPPHTTEATCNLWCVYVHETVLGIPRSRANIALWPPVREKRVRIYLSKGPNVKNWNAWTALETYLQLQEAFGWEPFIRLFTEYRNQTNLPTENVDKMNLWVKMFSHQVQKNLAPFFEAWAWPIQKEVATSLAYLPEWKENIMKLYLLTQMPH

SEQ ID NO: 12082 - protein, 75 aa, Homo sapiens
MATPSAAFEALMNGVTSWDVPEDAVPCELLLIGEASFPVMVNDMGQVLIAASSYGRGRLVVVSHEDYLVEAQLTP

SEQ ID NO: 12083 - protein, 150 aa, Homo sapiens
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLI

SEQ ID NO: 12084 - protein, 845 aa, Homo sapiens
MATIAAAAFEALMDGVTCWDVPRGPIPSELLLIGEAAFPVMVNDKGQVLIAASSYGRGRLVVVSHEGYLSHTGLAPFLLNAVSWLCPCPGAPVGVHPSLAPLVNILQDAGLEAQVKPEPGEPLGVYCINAYNDTLTATLIQFVKHGGGLLIGGQAWYWASQHGPDKVLSRFPGNKVTSVAGVYFTDTYGDRDRFKVSKKVPKIPLHVRYGEDVRQDQQQLLEGISELDIRTGGVPSQLLVHGALAFPLGLDASLNCFLAAAHYGRGRVVLAAHECLLCAPKMGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQVLSRNSGRRG

SEQ ID NO: 12085 - protein, 815 aa, Homo sapiens
MKIFQKEFKFILKKCTPIQKYREENGNSSSSPHHQLQSHASGPRYGEDVRQDQQQLLEGISELDIRTGGVPSQLLVHGALAFPLGLDASLNCFLAAAHYGRGRVVLAAHECLLCAPKMGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPESHSVIQVGMQWRDLSSCNLHLLGLSNSSLSASCVAGTTGTRHHAWLIFVFLVEREFHRKGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQLQEAFGWEPFTQLFAEYQTLSHLPKDNTGRMNLWVKKFSEKVKKNLVPFFEAWGWPIQKEVADSLASLPEWQENPMQVYLRARK

SEQ ID NO: 12086 - protein, 564 aa, Homo sapiens
MGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQVLSRNSGRRG

SEQ ID NO: 12087 - protein, 564 aa, Homo sapiens; identical to SEQ ID NO: 12086

SEQ ID NO: 12088 - protein, 919 aa, Homo sapiens
MATIAAAAFEALMDGVTCWDVPRGPIPSELLLIGEAAFPVMVNDKGQVLIAASSYGRGRLVVVSHEGYLSHTGLAPFLLNAVSWLCPCPGAPVGVHPSLAPLVNILQDAGLEAQVKPEPGEPLGVYCINAYNDTLTATLIQFVKHGGGLLIGGQAWYWASQHGPDKVLSRFPGNKVTSVAGVYFTDTYGDRDRFKVSKKVPKIPLHVRYGEDVRQDQQQLLEGISELDIRTGGVPSQLLVHGALAFPLGLDASLNCFLAAAHYGRGRVVLAAHECLLCAPKMGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQLQEAFGWEPFTQLFAEYQTLSHLPKDNTGRMNLWVKKFSEKVKKNLVPFFEAWGWPIQKEVADSLASLPEWQENPMQVYLRARK

SEQ ID NO: 12089 - protein, 845 aa, Homo sapiens; identical to SEQ ID NO: 12084

SEQ ID NO: 12090 - protein, 608 aa, Homo sapiens
MALRGPAGLGPGSRRPLDEAVAGAEGREAPALVAAGGAPEDDEEDDGRGRGLLRWDSFSAWLHCVCVVGFDLELGQAVEVIYPQHSKLTDREKTNICYLSFPDSNSGCLGDTQFCFRFRQSSGRRVSLHCLLDQFDKDLPVYLKKDPAYFYGYVYFRQVRDKTLKRGYFQKSLVLISKLPYIHFFHTVLKQIAPEYFEKNEPYLEAACNDVDRWPAPVPGKTLHLPIMGVVMKVRIPTCHDKPGTTQIVQLTQQVDTNISVILPTVHEVDIFRCFCPVFLHSQMLWELVLLGEPLVVMAPSPSESSETVLALVNCISPLKYFSDFRPYFTIHDSEFKEYTTRTQAPPSVILGVTNPFFAKTLQHWPHIIRIGDLKPTGEIPKQVKVKKLKNLKTLDSKPGVYTSYKPYLNRDEEIIKQLQKGVQQKRPSEAQSVILRRYFLELTQSFIIPLERYVASLMPLQKSISPWKSPPQLRQFLPEEFMKTLEKTGPQLTSRIKGDWIGLYRHFLKSPNFDGWFKTRRKEMTQKLEALHLEALCEEDLLLWIQKHTEVETVDLVLKLKNKLLQADREHLPVKPDTMEKLRTHIDAIILALPEDLQGILLKTGMT

SEQ ID NO: 12091 - protein, 585 aa, Homo sapiens
MDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPPNVVLGVTNPFFIKTLQHWPHILRVGEPKMSGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 12092 - protein, 453 aa, Homo sapiens
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 12093 - protein, 345 aa, Homo sapiens
MRDKATQTESAWAEEYSEKKKGSHKRSASWGSTDQLKEIAKLRQQLQRSKHSSRHHRDKERQSPFHGNHAAINQCQAPVPKSALIPVIPITKSTGSRFRNSVEGLNQEIEIIIKETGEKEEQLIPQDIPDGHRAPPPLVQRSSSTRSIDTQTPGGADRGSNNSSRSQSVSPTSFLTISNEGSEESPCSADDLLVDPRDKENGNNSPLPKYATSPKPNNSYMFKREPPEGCERVKVFEECSPKQLHEIPAFYCPDKNKVNFIPKSGSAFCLVSILKPLLPTPDLTLKGSGHSLTVTTGMTTTLLQPIAVASLSTNTEQDRVSRGTSTVMPSASLLPPPEPIEEAEG

SEQ ID NO: 12094 - protein, 589 aa, Homo sapiens
MSQRVRRNGSPTPAGSLGGGAVATAGGPGSRLQPMRATVPFQLKQQQQQQHGSPTRSGGGGGGNNNGGCCGGASGPAGGGGGGGPRTASRSTSPTRGGGNAAARTSPTVATQTGASATSTRGTSPTRSAAPGARGSPPRPPPPPPLLGTVSSPSSSPTHLWTGEVSAAPPPARVRHRRRSPEQSRSSPEKRSPSAPVCKAGDKTRQPSSSPSSIIRRTSSLDTLAAPYLAGHWPRDSHGQAAPCMRDKATQTESAWAEEYSEKKKGSHKRSASWGSTDQLKEIAKLRQQLQRSKHSSRHHRDKERQSPFHGNHAAINQCQAPVPKSALIPVIPITKSTGSRFRNSVEGLNQEIEIIIKETGEKEEQLIPQDIPDGHRAPPPLVQRSSSTRSIDTQTPGGADRGSNNSSRSQSVSPTSFLTISNEGSEESPCSADDLLVDPRDKENGNNSPLPKYATSPKPNNSYMFKREPPEGCERVKVFEECSPKQLHEIPAFYCPDKNKVNFIPKSGSAFCLVSILKPLLPTPDLTLKGSGHSLTVTTGMTTTLLQPIAVASLSTNTEQDRVSRGTSTVMPSASLLPPPEPIEEAEG

SEQ ID NO: 12095 - protein, 351 aa, Homo sapiens
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLMENGALVLTTNFDNLLELYAADQGKQLESLDLTDEKKVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 12096 - protein, 73 aa, Homo sapiens
MRLILNLCRGAGCNRQAVAGQLLPSTWSLHAHGLAKEAPILPVKKISRSCSVNNKVSKKTTKPPTLRSFLSPI

SEQ ID NO: 12097 - protein, 256 aa, Homo sapiens
MGKTKDIGDDDTVASEFWSGALSQPSSVPTRPRTPNRDSWRRAWAARGLHPRPSILQPGPARLSRARAGGTRCPQRRHGRATFCALGRGIGVRRGPGPRPARIPGLTLTWKRMSARRMQWAMQTGGRNQTFGGGVPLFWTWLTICCAVWRSLPCRLTHSCSRAFSSAPLKKTKSSMLPPKQALASAARNLCRGAGCNRQAVAGQLLPSTWSLHAHGLAKEAPILPVKKISRSCSVNNKVSKKTTKPPTLRSFLSPI

SEQ ID NO: 12098 - protein, 271 aa, Homo sapiens
MAQEKMELDLELPPGTGGSPAEGGGSGGGGGLRRSNSAPLIHGLSDTSPVFQAEAPSARRNSTTFPSRLHQIKQEEGMDLINRETVHEREVQTAMQISHSWEESFSLSDNDVEKSASPKRIDFIPVSPAPSPTRGIGKQCFSPSLQSFVSSNGLPPSPIPSPTTRFTTRRSQSPINCIRPSVLGPLKRKCEMETEYQPKRFFQGITNMLSSDVAQLSDPGVCVSSDTLDGNSSSAGSSCNSPAKVSTTTDSPVSPAQAASPFIPLDELSSK

SEQ ID NO: 12099 - protein, 287 aa, Homo sapiens
MAQEKMELDLELPPGTGGSPAEGGGSGGGGGLRRSNSAPLIHGLSDTSPVFQAEAPSARRNSTTFPSRHGLLLPASPVRMHSSRLHQIKQEEGMDLINRETVHEREVQTAMQISHSWEESFSLSDNDVEKSASPKRIDFIPVSPAPSPTRGIGKQCFSPSLQSFVSSNGLPPSPIPSPTTRFTTRRSQSPINCIRPSVLGPLKRKCEMETEYQPKRFFQGITNMLSSDVAQLSDPGVCVSSDTLDGNSSSAGSSCNSPAKVSTTTDSPVSPAQAASPFIPLDELSSK

SEQ ID NO: 12100 - protein, 241 aa, Homo sapiens
MAQEKMELDLEPDTSYGGTLRRSSSAPLIHGLSDLSQVFQPYTLRTRRNSTTIMSRHSLLLSSSPNRIPSSRLHQIKREEGLDMVNRETAHEREMQTAMQISQSWDESLSLSDSDFDKPEKLYSPKRIDFTPVSPAPSPTRGFGKMFVSSSGLPPSPVPSPRRFSRRSQSPVKCIRPSVLGPLKRKGEMETESQPKRLFQGTTNMLSPDAAQLSDLSSWWCYQGEEIPALTRCVEHLQMNE

SEQ ID NO: 12101 - protein, 266 aa, Homo sapiens
MAQEKMELDLEPDTSYGGTLRRSSSAPLIHGLSDLSQVFQPYTLRTRRNSTTIMSRHSLLLSSSPNRIPSSRLHQIKREEGLDMVNRETAHEREMQTAMQISQSWDESLSLSDSDFDKPEKLYSPKRIDFTPVSPAPSPTRGFGKMFVSSSGLPPSPVPSPRRFSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 12102 - protein, 65 aa, Homo sapiens
MAQEKMELDLEPDTSYGGTLRRSSSAPLIHGLSDLSQVFQPYTLRTRRNSTTIMSRHSLLHIWHF

SEQ ID NO: 12103 - protein, 247 aa, Homo sapiens
MAQEKMELDLEPDTSYGGTLRRSSSAPLIHGLSDLSQVFQPYTLRTRRNSTTIMSRHSLEEGLDMVNRETAHEREMQTAMQISQSWDESLSLSDSDFDKPEKLYSPKRIDFTPVSPAPSPTRGFGKMFVSSSGLPPSPVPSPRRFSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 12104 - protein, 111 aa, Homo sapiens
MAQEKMELDLEPDTSYGGTLRRSSSAPLIHGLSDLSQVFQPYTLRTRRNSTTIMSRHSLLLVPKGYMERVDKIYKRHQEEGLDMVNRETAHEREMQTAMQISQSWDESLSL

SEQ ID NO: 12105 - protein, 248 aa, Homo sapiens
MAQEKMELDLEPDTSYGGTLRRSSSAPLIHGLSDLSQVFQPYTLRTRRNSTTIMSRHSLEEGLDMVNRETAHEREMQTAMQISQSWDESLSLSDSDFDKPEKLYSPKRIDFTPVSPAPSPTRGFGKMFVSSSGLPPSPVPSPRRFSSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 12106 - protein, 195 aa, Homo sapiens
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLVKWHFNINQKRFSKAQPTCFLLILPNCQKIMCIYFQLLLMETTAMLDLLVIRQLKSALSQTLLCHLLILVLICSSRQTFN

SEQ ID NO: 12107 - protein, 152 aa, Homo sapiens
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLNDNGLQKSSSLKCIDLTPVSSMASSIKKTGKSTSSYF

SEQ ID NO: 12108 - protein, 115 aa, Homo sapiens
MAYFPGTGRTDQETQLDLSLCGREPESLENLFLDPDMAQEKMKLGFKSLPSSTTADGNILRRVNSAPLINGLGFNSQVLQADMLRIRTNRTTFRNRRSLEITSPTSVEQKPKDLF

SEQ ID NO: 12109 - protein, 185 aa, Homo sapiens
MDLINRETMSEWKLQSEIQISHSWEEGLKLNDNGLQKSSSLKCIDLTPVSSMASSIKKTGKQCFSPSLQTCVSCTGSPSSPIPSPMQQYIIRSQNPTNIIRPSILGPLKRKGEMAFQYQPKKIFQGTTNMLSSDTSQLSENNVYLLPATFDGNDSNAGSSGNSSAEIGTVTNSPVSPSDTGSHLF

SEQ ID NO: 12110 - protein, 552 aa, Homo sapiens
METSRSRGGGGAVSERGGAGASVGVCRRKAEAGAGTGTLAADMDLHCDCAAETPAAEPPSGKINKAAFKLFKKRKSGGTMPSIFGVKNKGDGKSSGPTGLVRSRTHDGLAEVLVLESGRKEEPRGGGDSGGGGGGRPNPGPPRAAGPGGGSLASSSVAKSHSFFSLLKKNGRSENGKGEPVDASKAGGKQKRGLRGLFSGMRWHRKDKRAKAEAAEGRAPGGGLILPGSLTASLECVKEETPRAAREPEEPSQDAPRDPAGCGDIIADQEEEAGPSCDKHVPGPGKPALSKKNPGVVAYQGGGEEMASPDEVDDTYLQEFWDMLSQTEEQGPEPQEGAAKVAAALETKVVPETPKDTRCVEAAKDASSVKRRRLNRIPIEPHPKEEPKHPEKEQQEGVPNSDEGYWDSTTPGPEEDSSSSGKKAGIPRDSYSGDALYDLYADPDGSPATLPGGKDNEETSSLSRLKPVSPGTITCPLRTPGSLLKDSKIPISIKHLTNLPSSHPVVHQQPSRSEMPRTKIPVSKVLVRRVSNRGLAGTTIRATACHDSAKKL

SEQ ID NO: 12111 - protein, 552 aa, Homo sapiens; identical to SEQ ID NO: 12110

SEQ ID NO: 12112 - protein, 671 aa, Homo sapiens
METSRSRGGGGAVSERGGAGASVGVCRRKAEAGAGTGTLAADMDLHCDCAAETPAAEPPSGKINKAAFKLFKKRKSGGTMPSIFGVKNKGDGKSSGPTGLVRSRTHDGLAEVLVLESGRKEEPRGGGDSGGGGGGRPNPGPPRAAGPGGGSLASSSVAKSHSFFSLLKKNGRSENGKGEPVDASKAGGKQKRGLRGLFSGMRWHRKDKRAKAEAAEGRAPGGGLILPGSLTASLECVKEETPRAAREPEEPSQDAPRDPAGEPAGGEEVPAPADRAPARSCREAEGLAHPGDTGARGEDAAGHRRAEPGPGEVRTAEDASRTGAVPVKTVPLVDSEGGSGRAPAAPDPASVDPPSDPSADRICLMFSDVTSLKSFDSLTGCGDIIADQEEEAGPSCDKHVPGPGKPALSKKNPGVVAYQGGGEEMASPDEVDDTYLQEFWDMLSQTEEQGPEPQEGAAKVAAALETKVVPETPKDTRCVEAAKDASSVKRRRLNRIPIEPHPKEEPKHPEKEQQEGVPNSDEGYWDSTTPGPEEDSSSSGKKAGIPRDSYSGDALYDLYADPDGSPATLPGGKDNEETSSLSRLKPVSPGTITCPLRTPGSLLKDSKIPISIKHLTNLPSSHPVVHQQPSRSEMPRTKIPVSKVLVRRVSNRGLAGTTIRATACHDSAKKL

SEQ ID NO: 12113 - protein, 861 aa, Homo sapiens
MELKRGKTFIKSSLQVSHEKPPDPAAVAAAREGTGPWSVLPGGQQRPHSEKGPQASPSAQEYDRCPNKGAQLDPKGGPAALCGATFKPVRKCKTHDSMSGAGRATAATGQLVGSASFPGSPGSRRMIDYRHFVPQMPFVPAVAKSIPRKRISLKRPKKCFRNLFHIRRNKTEDLASLAAEGKSLPSPGDPSDPGGRRSKAFLPPGEGPGLDGLCQDLLDSELLADASFGLCRALCEDVASLQSFDSLTGCGEVFADESSVPSLELNEGPESPTQAAQGLESKVPRGPLQGSVEQLASPAQNEASDFTRFWDSVNRSVRQQQRALLGPWLSGPQGTDRDQSRLDTAGLAELPLCPCRDPRSGSKASSIDTGTPKSEQPESVSTSDEGYYDSFSPGLEEDKKEAESPGTPAATFPRDSYSGDALYELFHDPSEGPLGPSPDDDLCVSESLSGPALGTPLSICSFRVGAEENLAPAPGPDLLSQGFLQSSWKGKECLLKLCDTELAITMGIVSWLRRGPTPRAPPTPGQPAAPPGSQGAPRAPTEKLGGREGLASDAGGATVCSAPSRQELWAHPGTTGLLAGESKALGGATQGTGTLSRDASREEETRGHSEGLFSSMESAATSTTDTSGKNKAPVPSTWPCSQKEPGPPGVLGCFRGPWRPGHGGDTLDAEPMLAGCVARVAALKISSNEQPPAAWPPRQDMGSGLFGQRWARGPDMLEQKQSSSSPSMTTIHGLPYSASTQDQRCRDRVQDLSWLRVEPTGLGVQAWASVEDQPLQLSTEAVEQVAHGSQLDSEPRSAPAARWSSQGHHPESLGLTLNSQQEGGVSASAPECRCSLLAREGLLCGQPEVGASGPAMAEPHL

SEQ ID NO: 12114 - protein, 861 aa, Homo sapiens; identical to SEQ ID NO: 12113

SEQ ID NO: 12115 - protein, 142 aa, Homo sapiens
MELKRGKTFIKSSLQVSHEKPPDPAAVAAAREGTGPWSVLPGGQQRPHSEKGPQASPSAQEYDRCPNKGAQLDPKGGPAALCGATFKPVRKCKTHDSMSGAGRATAATGQLVGSASFPGSPGSRRMIDYRHFVPQMPFVPAV

SEQ ID NO: 12116 - protein, 180 aa, Homo sapiens
MELKRGKTFIKSSLQVSHEKPPDPAAVAAAREGTGPWSVLPGGQQRPHSEKGPQASPSAQEYDRCPNKGAQLDPKGGPAALCGATFKPVRKCKTHDSMSGAGRATAATGQLVGSASFPGSPGSRRMIDYRHFVPQMPFVPAVAKSIPRKRISLKRPKKCFRNLFHIRRNKTEDLASLAAE

SEQ ID NO: 12117 - protein, 582 aa, Homo sapiens
MDPKAGGGGEEDDCVDSGAETGGSDYSHLSSTSNGFSTWRMPCCLFLYCTHGDKEKGRWSLQVEHTWPSGELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQAQRVHKKFPKPGRVHHASEKKRHSTPLPSTAVPSHTPGSSQQSPLNSPHPGPIRTGLPPGHQQEFAGRANSTPNPPWSFQRSKSLFCLPTGGPSLASSAEPQWFSNTGAPGHRASEWRHGHLLSIDDLEGAQETDVDTGLRLSSSDLSVVSAYSAPSRFCSTVETPLPSERCSSHWAAHKDSREGPLPTVSRVTTEASWASLPFFTKRSSSSSATARAAPPAPSTSTLTDSSPQLPCDTPKVKQTDGDMPPPPGSAGPGDNDMEEFYI

SEQ ID NO: 12118 - protein, 546 aa, Homo sapiens
MDPKAGGGGEEDDCVDSGAETGGSDYSHLSSTSSELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQAQRVHKKFPKPGRVHHASEKKRHSTPLPSTAVPSHTPGSSQQSPLNSPHPGPIRTGLPPGHQQEFAGRANSTPNPPWSFQRSKSLFCLPTGGPSLASSAEPQWFSNTGAPGHRASEWRHGHLLSIDDLEGAQETDVDTGLRLSSSDLSVVSAYSAPSRFCSTVETPLPSERCSSHWAAHKDSREGPLPTVSRVTTEASWASLPFFTKRSSSSSATARAAPPAPSTSTLTDSSPQLPCDTPKVKQTDGDMPPPPGSAGPGDNDMEEFYI

SEQ ID NO: 12119 - protein, 272 aa, Homo sapiens
MDETQGPLAMTVHLLANSGHGSLLQRTLDQLLDCICPEVRLFQVSERASPVKYCEKSHSKRSRFPGMSVLLFLHESPGEDRLFRVLDSLQHSPWQCYPTQDTRGRLCPYFFANQEFYSLDSQLPIWGVRQVHCGSEILRVTLYCSFDNYEDAIRLYEMILQREATLQKSNFCFFVLYASKSFALQLSLKQLPPGMSVDPKESSVLQFKVQEIGQLVPLLPNPCMPISSTRWQTQDYDGNKILLQRWESSSVAQTRVRWCHHSSLRSSPSGFK

SEQ ID NO: 12120 - protein, 272 aa, Homo sapiens; identical to SEQ ID NO: 12119

SEQ ID NO: 12121 - protein, 455 aa, Homo sapiens
MDETQGPLAMTVHLLANSGHGSLLQRTLDQLLDCICPEVRLFQVSERASPVKYCEKSHSKRSRFPGMSVLLFLHESPGEDRLFRVLDSLQHSPWQCYPTQDTRGRLCPYFFANQEFYSLDSQLPIWGVRQVHCGSEILRVTLYCSFDNYEDAIRLYEMILQREATLQKSNFCFFVLYASKSFALQLSLKQLPPGMSVDPKESSVLQFKVQEIGQLVPLLPNPCMPISSTRWQTQDYDGNKILLQVQLNPELGVKNGILGAGMLPLGSRLTSVSAKRTSEPRSQRNQGKRSQGHSLELPEPSGSPTSDRCAGTSWKSPGRSFQVSSPAMGAHLHLSSHHLESGARMKVLNRENSFQKLEAETNVDTGLTIINSEPRQTYFGGFPRDLQTSQPPFCLPASSLGVATSKNNSVLKERVSPLPLAGQRDLGTRKTISECLLHLQVQGEEKEEDEEEFFI

SEQ ID NO: 12122 - protein, 530 aa, Homo sapiens
MLGTDRCVVEEWLSEFKALPDTQITSYAATLHRKKTLVPALYKVIQDSNNELLEPVCHQLFELYRSSEVRLKRFTLQFLPELMWVYLRLTVSRDRQSNGCIEALLLGIYNLEIADKDGNNKVLSFTIPSLSKPSIYHEPSTIGSMALTEGALCQHDLIRVVYSDLHPQRETFTAQNRFEVLSFLMLCYNSAIVYMPASSYQSLCRMGSRVCVSGFPRQHEKHWKELCGRIVLDPEFMVQLLTGVYYAMYNGQWDLGQEVLDDIIYRAQLELFSQPLLVANAMKNSLPFDAPDSTQEGQKVLKVEVTPTVPRISRTAITTASIRRHRWRREGAEGVNGGEESVNLNDADEGFSSGASLSSQPIGTKPSSSSQRGSLRKVATGRSAKDKETASAIKSSESPRDSVVRKQYVQQPTDLSVDSVELTPMKKHLSLPAGQVVPKINSLSLIRTASASSSKSFDYVNGSQASTSIGVGTEGGTNLAANNANRYSTVSLQEDRLGQAGEGKELLSPGAPLTKQSRSPSFNMQLISQV

SEQ ID NO: 12123 - protein, 208 aa, Homo sapiens
MLGTDRCVVEEWLSEFKALPDTQITSYAATLHRKKTLVPALYKVIQDSNNELLEPVCHQLFELYRSSEVRLKRFTLQFLPELMWVYLRLTVSRDRQSNGCIEALLLGIYNLEIADKDGNNKVLSFTIPSLSKPSIYHEPSTIGSMALTEGALCQHDLIRVVYSDLHPQRETFTAQNRFEVLSFLMLCYNSAIVYMPASSYQSLCRMGS

SEQ ID NO: 12124 - protein, 87 aa, Homo sapiens
MLGTDRCVVEEWLSEFKALPDTQITSYAATLHRKKTLVPALYKVIQDSNNELLEPVCHQLFELYRSSEVRLKRFTLQFLPELMWVYL

SEQ ID NO: 12125 - protein, 113 aa, Homo sapiens
MDGRVQLMKALLAGPLRPAARRWRNPIPFPETFDGDTDRLPEFIVQTSSYMFVDENTFSNDALKVTFLITRLTGPALQWVIPYIRKESPLLNDYRGFLAEMKRVFGWEEDEDF

SEQ ID NO: 12126 - protein, 113 aa, Homo sapiens
MEGRVQLMKALLARPLRPAARRWRNPIPFPETFDGDTDRLPEFIVQTSSYMFVDENTFSNDALKVTFLITRLTGPALQWVIPYIKKESPLLSDYRGFLAEMKRVFGWEEDEDF

SEQ ID NO: 12127 - protein, 208 aa, Homo sapiens
MGGGRGLLGRETLGPGDRCSGKGPLCYWPPPGSPPAPSLRASLPLEPPRCPLRSCPLPRSACLCSRNSAPGSCCRPWASLWSGLPPPSRASSAPPMHIWTLSCAPVAQAELLLHTDRPLPPLPTPLLLTRLPDDYIMLPTDLRCHCHRHPSHSTDRLLLLVICTHLGGIWAGHSPWTMIQTAGCPSRDLLPSARPISSPIPETFCAPA

SEQ ID NO: 12128 - protein, 593 aa, Homo sapiens
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKTESHSVAQAVVQWCDLGSLQPPPPRFKRSSHLSLPSSWDYRHPL

SEQ ID NO: 12129 - protein, 651 aa, Homo sapiens
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGADEETEAEREGGACPRQPDSGAQIQPLCPPPSPGTFRS

SEQ ID NO: 12130 - protein, 697 aa, Homo sapiens
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGAAPNLNLVSSFLAGRQAFTDFLCLPAKSSANWILAASLLSCSCFRSGFHRDSRVFLVQLAEGLSHSLETVSSHSVWSFRPTPRQ

SEQ ID NO: 12131 - protein, 615 aa, Homo sapiens
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKELPEFEGDVLAVGSQALTTEGIYEDVIRGCLLQRIDQELKKTLGANDVSCTLDGCLEVPWEQEGADEETEAEREGGACPRQPDSGAQIQPLCPPPSPGTFRS

SEQ ID NO: 12132 - protein, 569 aa, Homo sapiens
MGGRPSSPLDKQQRQHLRGQVDTLLRNFLPCYRGQLAASVLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQDEETEAEREGGACPRQPDSGAQIQPLCPPPSPGTFRS

SEQ ID NO: 12133 - protein, 423 aa, Homo sapiens
MREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGAAPNLNLVSSFLAGRQAFTDFLCLPAKSSANWILAASLLSCSCFRSGFHRDSRVFLVQLAEGLSHSLETVSSHSVWSFRPTPRQ

SEQ ID NO: 12134 - protein, 915 aa, Homo sapiens
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAISLLRFFLQELPEPVIPGSLHIHLMQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKKMTKDHLVEEKASLQKSLLYYESQHGRPVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 12135 - protein, 887 aa, Homo sapiens
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAISLLRFFLQELPEPVIPGSLHIHLMQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 12136 - protein, 791 aa, Homo sapiens
MQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEASCPITFPLIDFKTMHLQRDGEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 12137 - protein, 95 aa, Homo sapiens
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAI

SEQ ID NO: 12138 - protein, 52 aa, Homo sapiens
MRKSSSPSLSNCNSVLANKIFGIPLDELQQGGHPDNEVPFIVRHVVDYIEEH

SEQ ID NO: 12139 - protein, 64 aa, Homo sapiens
MRKSSSPSLSNCNSVLANKIFGIPLDELQQGGHPDNEVPFIVRHVVDYIEEHGGLEQQGLFQVN

SEQ ID NO: 12140 - protein, 87 aa, Homo sapiens
MRKSSSPSLSNCNSVLANKIFGIPLDELQQGGHPDNEVPFIVRHVVDYIEEHGGLEQQGLFQVNGNAETVEWLRQRYDSGEEVDLVK

SEQ ID NO: 12141 - protein, 142 aa, Homo sapiens
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAISLLRFFLQELPEPVIPGSLHIHLMQLSQDYNNEDEFGRKLRFLLQQL

SEQ ID NO: 12142 - protein, 501 aa, Homo sapiens
MGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 12143 - protein, 585 aa, Homo sapiens
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 12144 - protein, 487 aa, Homo sapiens
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 12145 - protein, 458 aa, Homo sapiens
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIVSQDTCMLLLCTDV

SEQ ID NO: 12146 - protein, 502 aa, Homo sapiens
MGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 12147 - protein, 5 aa, Homo sapiens
MGNFK

SEQ ID NO: 12148 - protein, 25 aa, Homo sapiens
MGNFKSRKPKSIFKAESGRSHGESQ

SEQ ID NO: 12149 - protein, 332 aa, Homo sapiens
MDSTSSLHGSSLHRPSTEQTRTDFSWDGINLSMEDTTSILPKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANN

SEQ ID NO: 12150 - protein, 332 aa, Homo sapiens; identical to SEQ ID NO: 12149

SEQ ID NO: 12151 - protein, 332 aa, Homo sapiens; identical to SEQ ID NO: 12149

SEQ ID NO: 12152 - protein, 360 aa, Homo sapiens
MGCIGSRTVGNEVIAVDWKGLKDVDQINMDSTSSLHGSSLHRPSTEQTRTDFSWDGINLSMEDTTSILPKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANN

SEQ ID NO: 12153 - protein, 336 aa, Homo sapiens
FLLGRHQRTVSTHVLNLCPSFPEHWGYIPPWDSWLSMEDTTSILPKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANN

SEQ ID NO: 12154 - protein, 280 aa, Homo sapiens
MGSCVSRDLFTSAHKNCPMPQGADPLNPDLPSGRTPTVAPDCVIGKDKQMDFCWDPWQRCFQTTNGYLSDSRSRPGNYNVAALATSSLVGVVQSIKDHITKPTAMARGRVAHLIEWKGWSAQPAGWELSPAEDEHYCCLPDELREARFAAGVAEQFAITEATLSAWSSLDEEELHPENSPQGIVQLQDLESIYLQDSLPSGPSQDDSLQAFSSPSPSPDSCPSPEEPPSTAGIPQPPSPELQHRRRLPGAQGPEGGTHPPGSLPSMDSGSLWEEDEVFYN

SEQ ID NO: 12155 - protein, 248 aa, Homo sapiens
MGKRDNRVAYMNPIAMARWRGPTQSVGPTIQDYLNRPRPTWEEVKKQLENKKTGSKALAEFEEKMNENWKKELEKSREKLLSGNESSSKKRERKKKRKKKSCRSSSSSSSSDSSSSSSDSEDEEKKQGKRRKKKKNRSYKSSQSSTHESESESKESVKKKKKSKDETEKEKDVRSLSKKRKKSYPDDKPLSSESSSESDYEEDVQAKKKRRCEEREQAKEKVKKKKKKQHKKHSKKKKKKSGSSHKSR

SEQ ID NO: 12156 - protein, 248 aa, Homo sapiens; identical to SEQ ID NO: 12155

SEQ ID NO: 12157 - protein, 248 aa, Homo sapiens; identical to SEQ ID NO: 12155

SEQ ID NO: 12158 - protein, 248 aa, Homo sapiens; identical to SEQ ID NO: 12155

SEQ ID NO: 12159 - protein, 237 aa, Homo sapiens
MNPIAMARSRGPIQSSGPTIQDYLNRPRPTWEEVKEQLEKKKKGSKALAEFEEKMNENWKKELEKHREKLLSGSESSSKKRQRKKKEKKKSGRYSSSSSSSSDSSSSSSDSEDEDKKQGKRRKKKKNRSHKSSESSMSETESDSKDSLKKKKKSKDGTEKEKDIKGLSKKRKMYSEDKPLSSESLSESEYIEEVRAKKKKSSEEREKATEKTKKKKKHKKHSKKKKKKAASSSPDSP

SEQ ID NO: 12160 - protein, 237 aa, Homo sapiens; identical to SEQ ID NO: 12159

SEQ ID NO: 12161 - protein, 247 aa, Homo sapiens
MGKRDNRVAYMNPIAMARSRGPIQSSGPTIQDYLNRPRPTWEEVKEQLEKKKKGSKALAEFEEKMNENWKKELEKHREKLLSGSESSSKKRQRKKKEKKKSGRYSSSSSSSSDSSSSSSDSEDEDKKQGKRRKKKKNRSHKSSESSMSETESDSKDSLKKKKKSKDGTEKEKDIKGLSKKRKMYSEDKPLSSESLSESEYIEEVRAKKKKSSEEREKATEKTKKKKKHKKHSKKKKKKAASSSPDSP

SEQ ID NO: 12162 - protein, 30 aa, Homo sapiens
MNPIAMARSRGPIQSSGPTIQDYLNRPRPT

SEQ ID NO: 12163 - protein, 85 aa, Homo sapiens
MLLTIETKSHYVAQAGLELLASSDPPTSASQSVGIIDMSHCTWPTLGKFLNPSKPHFSPITKGKDGNIFPTKFLSDALTELRLCT

SEQ ID NO: 12164 - protein, 74 aa, Homo sapiens
MLLTIETKSHYVAQAGLELLASSDPPTSASQSVGIIDMSHCTWPTLGKFLNPSKPHFSPITKGKDGNIFPTKFL

SEQ ID NO: 12165 - protein, 85 aa, Homo sapiens; identical to SEQ ID NO: 12163

SEQ ID NO: 12166 - protein, 85 aa, Homo sapiens; identical to SEQ ID NO: 12163

SEQ ID NO: 12167 - protein, 482 aa, Homo sapiens
MLFEGKVNPQTQSLLAECGEWTRRSLHLRVLGRQLILPTDKGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRKLGLPPVSPRDCVKDAVAAEVFDHVWTNMVELLEELIRKHWETTLTEGKKQRETLKVAGNRFPHVLVPHAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGSQYVPKSFQRTTLTFKRRFQVTS

SEQ ID NO: 12168 - protein, 773 aa, Homo sapiens
MKAAVLDLGSLLAKLFETSTAPPAGPSSRPSGGAAAAGSGGSRAGTPLGTAPTLLRALAPDSPSASRRSPAPLLSSPYSRGSAASRAAGAVGTLLSWPSSPRAGKAPPQPPTPSGGGCSPARLVVPARPPSGPGGVWAALPRNPLQPGPGERELGACVAPGAGPRTLFLTLPDIGEEGASDGDSGDGEARGLSEGRRRHGFTVRSKDSLPTHFTRNVQKAIDKYTCKSLSSFSSSGSHTPTGAHTSWSGSATQSSTTGSSTERGSVYSWRDDEFDEASSQSVQRLLWEVEEMLFEGKVNPQTQSLLAECGEWTRRSLHLRVLGRQLILPTDKGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRKLGLPPVSPRDCVKDAVAAEVFDHVWTNMVELLEELIRKHWETTLTEGKKQRETLKVAGNRFPHVLVPHAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGSQYVPKSFQRTTLTFKRRFQVTS

SEQ ID NO: 12169 - protein, 482 aa, Homo sapiens; identical to SEQ ID NO: 12167

SEQ ID NO: 12170 - protein, 482 aa, Homo sapiens; identical to SEQ ID NO: 12167

SEQ ID NO: 12171 - protein, 61 aa, Homo sapiens
MLFEGKVNPQTQSLLAECGEWTRRSLHLRVLGRQLILPTDKGVQHFQGSTPASAVHRPPLS

SEQ ID NO: 12172 - protein, 582 aa, Homo sapiens
MISRYTRKAVPQSLELKGITKHALNHHPPPEKLEEISPTSDSHEKDTSSQSKSDITRESSFTSADTGNSLSAFPSYTGAGISTEGSSDFSWGYGELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLLDTQYRRSCAVEYPHQARPGRGSAGPQLHGSTKSQSGGRPVSRTRQGP

SEQ ID NO: 12173 - protein, 469 aa, Homo sapiens
  MOD_RES (1)..(1): Any amino acid
XFTSADTGNSLSAFPSYTGAGISTEGSSDFSWGYGELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLVE

SEQ ID NO: 12174 - protein, 330 aa, Homo sapiens
MERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMLDTQYRRSCAVEYPHQARPGRGSAGPQLHGSTKSQSGGRPVSRTRQGP

SEQ ID NO: 12175 - protein, 335 aa, Homo sapiens
SSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMLDTQYRRSCAVEYPHQARPGRGSAGPQLHGSTKSQSGGRPVSRTRQGP

SEQ ID NO: 12176 - protein, 276 aa, Homo sapiens
MAASAGGPGSWSENILEYFLRNSQITAEDGAEITWYHAANHKAQTNEALKSTAHMIEADVLLPSDGSEHSQPIMAHPPETNSDNTLQEWLTEVMKSNKGIKLDFKSLAVVEPSMMLLENVKRHLKRPVWINADILPGPNGNSKVIDAKPFLDTVISFFPDVTFSLGWTTGWHPEKVNEGYSWTMVKEMEYICNELSQPVTFPVRAALVRQSCSQLLWLLKKSNRYSLTIWTGKNDNYSVEDLLYIRDHFDKKQVFYDILEPQNHEFKQAIGIKVNL

SEQ ID NO: 12177 - protein, 144 aa, Homo sapiens
MVDKDTERDIEMKRQLRRLRELHLYSTWKKYQEAMKTSLGVPQRGDLEDLEEHVPGQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 12178 - protein, 387 aa, Homo sapiens
MGCVYSCCLEVCCGEDEIVYPRMPGESTVCHREREKPITYHWYHWHPGHIYPRIASMEDYDEDLVQEASSEDVLGVHMVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHSERGISFSCDLEDLEEHGPGQTVSEEATEVHTMEGDPDTLAEFLIRDVLQELSSYNGEEEDPEEVKTSLGVPQRGDLEDLEEHVPGQTVSEEATGVHMMQVDPATLAKSDLEDLEEHVPEQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 12179 - protein, 387 aa, Homo sapiens
MGCAYSCCLEVCCGEDEIVYPRMPGESTVCHREREKPITYHWYHWHPGHIYPRVASMEDYDEDLVQEASSEDVLGVHMVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADTGIQTNGDLEDLEEHGPGQTVSEEATEVHMMEGDPDTLAELLIRDVLQELSSYNGEEEDPEEVKTSLGVPQRGDLEDLEEHVPGQTVSEEATGVHMMQVDPATPAKSDLEDLEEHVPGQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 12180 - protein, 310 aa, Homo sapiens
MVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADTGIQTNGDLEDLEEHGPGQTVSEEATEVHMMEGDPDTLAELLIRDVLQELSSYNGEEEDPEEVKTSLGVPQRGDLEDLEEHVPGQTVSEEATGVHMMQVDPATPAKSDLEDLEEHVPGQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 12181 - protein, 310 aa, Homo sapiens; identical to SEQ ID NO: 12180

SEQ ID NO: 12182 - protein, 114 aa, Homo sapiens
MVDKDTERDIEMKRQLRRLRELHLYSTWKKYQEAMKTSLGVPQRGDLEDLEEHLPGQTVSEEATGVHMMQVDPATPAKKLEDSTITGSHQQMSASPSSAPAEEATEKTKVEEEV

SEQ ID NO: 12183 - protein, 39 aa, Homo sapiens
MVDKDTERDIEMKRQLRRLRELHLYSTWKKYQEAMKTSL

SEQ ID NO: 12184 - protein, 144 aa, Homo sapiens
MVDKDTERDIEMKRQLRRLRELHLYSTWKKYQEAMKTSLGVPQRGDLEDLEEHLPGQTVSEEATGVHMMQVDPATPAKKLEDSTITGSHQQMSASPSSAPAEEATEKTKVEEEVKTRKPKKKTRKPSKKSRWNVLKCWDIFNIF

SEQ ID NO: 12185 - protein, 474 aa, Homo sapiens
MKTKCICELCSCGRHHCPHLPTKIYDKTEKPCLLSEYTENYPFYHSYLPRESFKPRREYQKGPIPMEGLTTSRRDFGPHKVAPVKVHQYDQFVPSEENMDLLTTYKKDYNPYPVCRVDPIKPRDSKYPCSDKMECLPTYKADYLPWNQPRREPLRLEHKYQPASVRFDNRTTHQDDYPIKGLVKTISCKPLAMPKLCNIPLEDVTNYKMSYVAHPVEKRFVHEAEKFRPCEIPFESLTTQKQSYRGLMGEPAKSLKPLARPPGLDMPFCNTTEFRDKYQAWPMPRMFSKAPITYVPPEDRMDLLTTVQAHYTCPKGAPAQSCRPALQIKKCGRFEGSSTTKDDYKQWSSMRTEPVKPVPQLDLPTEPLDCLTTTRAHYVPHLPINTKSCKPHWSGPRGNVPVESQTTYTISFTPKEMGRCLASYPEPPGYTFEEVDALGHRIYKPVSQAGSQQSSHLSVDDSENPNQRELEVLA

SEQ ID NO: 12186 - protein, 282 aa, Homo sapiens [sequence omitted]

SEQ ID NO: 12187 - protein, 398 aa, Homo sapiens
MGAKSMRSWCLCQICSCGSDYCPYEIVKQPRHVPEEYKPKQGKIDLGTTYKRDLNSYKVQPVAIVRPLERQVKKGKLDTVPTYKDDYRAWDLHKSELYKPEQTYHPPTVKFGNSTTFQDDFVPQEIKPRQSFKPSSVVKRSTAPFNGITSHRLDYIPHQLELKFERPKEVYKPTDQRFEDLTTHRCDFQGLIGETAKLCRPVHTRVTQNALFEGSTEFRESFQPWEIPPPEVKKVPEYVPPTGSMLLNSTSHLDYVPYQANHVVPIRPVSQKRSNNFPFQGKSIMKEDFPAWESCRQGLIKKQQQIPNPSGKFDGLSTFRSHYVPHELIPTESCKPLNIAFKSSVPFDDVTMYSVEYTPKRQEICPASYPSPPGYIFDNTNSQGHKFFRKIIPAVKAF

SEQ ID NO: 12188 - protein, 383 aa, Homo sapiens
MPWSDYCPYEIVKQPRHVPEEYKPKQGKIDLGTTYKRDLNSYKVQPVAIVRPLERQVKKGKLDTVPTYKDDYRAWDLHKSELYKPEQTYHPPTVKFGNSTTFQDDFVPQEIKPRQSFKPSSVVKRSTAPFNGITSHRLDYIPHQLELKFERPKEVYKPTDQRFEDLTTHRCDFQGLIGETAKLCRPVHTRVTQNALFEGSTEFRESFQPWEIPPPEVKKVPEYVPPTGSMLLNSTSHLDYVPYQANHVVPIRPVSQKRSNNFPFQGKSIMKEDFPAWESCRQGLIKKQQQIPNPSGKFDGLSTFRSHYVPHELIPTESCKPLNIAFKSSVPFDDVTMYSVEYTPKRQEICPASYPSPPGYIFDNTNSQGHKFFRKIIPAVKAF

SEQ ID NO: 12189 - protein, 383 aa, Homo sapiens
MGPLFTTIPGAHSGPMRPLPKKHVEPMAVRQLLLGNSTMIRHTCPMSVPLSRQVKEVAAQKPSEDIYKNWQQQQQQQQQQQQQQLDLLFHQRIQISLWPRKQKRRKTEQHSHPFVKKAFRFSAGSGCGRPSSNKMLRSMGGGQRPTGLGSEFFRLLHDLHLLAFAMKRIWIHRRGEATARPRAPEHPAPPATAVRGRDAASQNLKRRPGSGTDGLRLQGAEPSRLLRTYAGGAVIPTGTPERAQPPPPQDPLGRRRWLSRNTWGPWPGTTQPPSPQLLRNDWGSCGFMVPEAARGKVFQDSQEGAHIRRETVSKSVCAEPWRHQRARDPAPTNFPLRCQKQRGASASSGQHEGRVNLVFFIGSPTVIAVPDLQCPTKYSGMLY

SEQ ID NO: 12190 - protein, 208 aa, Homo sapiens
MGEVEISALAYVKMCLHAARYPHAAVNGLFLAPAPRSGECLCLTDCVPLFHSHLALSVMLEVALNQVDVWGAQAGLVVAGYYHANAAVNDQSPGPLALKIAGRIAEFFPDAVLIMLDNQKLVPQPRVPPVIVLENQGLRWVPKDKNLVMWRDWEESRQMVGALLEDRAHQHLVDFDCHLDDIRQDWTNQRLNTQITQWVGPTNGNGNA

SEQ ID NO: 12191 - protein, 208 aa, Homo sapiens; identical to SEQ ID NO: 12190

SEQ ID NO: 12192 - protein, 160 aa, Homo sapiens
MSEASRLCSGYYSLNQSFVEPFQCPRRGEGAALQYCCGFADLKYCCSEPGSYFPYKHSYMWSLSIGALIGLGIAALVLLAFVISVCVLCYLFLYTKPQRLDTGLKLQHLEASSTQEGKSNGKTKALNSNAASNATNETYYEADDIIQEKTMDATQIHIAY

SEQ ID NO: 12193 - protein, 1040 aa, Homo sapiens
MMSSVSTESKLQQAVSLQGVDPETCMIVFKNHWAQVVKILEKHDPLKNTQAKYGSIPPDEASAVQNYVEHMLFLLIEEQAKDAAMGPILEFVVSENIMEKLFLWSLRREFTDETKIEQLKMYEMLVTQSHQPLLHHKPILKPLMMLLSSCSGTTTPTVEEKLVVLLNQLCSILAKDPSILELFFHTSEDQGAANFLIFSLLIPFIHREGSVGQQARDALLFIMSLSAENTMVAHHIVENTYFCPVLATGLSGLYSSLPTKLEEKGEEWHCLLKDDWLLLPSLVQFMNSLEFCNAVIQVAHPLIRNQLVNYIYNGFLVPVLAPALHKVTVEEVMTTTAYLDLFLRSISEPALLEIFLRFILLHQHENVHILDTLTSRINTPFRLCVVSLALFRTLIGLHCEDVMLQLVLRYLIPCNHMMLSQRWAVKERDCYSVSAAKLLALTPVCCSSGITLTLGNQERDYILWSKCMHDTSGPVERPFPEAFSESACIVEYGKALDISYLQYLWEAHTNILRCMRDCRVWSALYDGDSPDPEMFLQSLTEEGSVSSACPVFGLPQQLPRKTGPQLAPRKDKSQTELEWDDSYDTGISSGADVGSPGPYDDLEVSGPPAPIDPPKHIQEMKKNALLLFKGSYIEESDFQDDVMVYRLCAEKDSEDMKDSQEEAARPPAEAQAEVQSVPINNGPLLSTQPETDSEEEWNRDNSDPFHSEPKEPKQEREPEAAPESNSELASPAPEAEHSSNLTAAHPESEELIAQYDQIIKELDSGAEGLMEQNYPTPDPLLLTKEEEGKEESKGEKEKEGKKELEDEEDDFDSFIAEMPAVETVPSPFVGRDEAAFASRHPVRTQSTPFTGPFISVVLSKLENMLENSLHVNLLLIGIITQLASYPQPLLRSFLLNTNMVFQPSVRSLYQVLASVKNKIEQFASVERDFPGLLIQAQQYLLFRVDMSDMTPAALTKDPIQEASRTGSGKNLLDGPPRVLQPFLTHRTKVAEAPPNLPLPVRNPMLAAALFPEFLKELAALAQEHSILCYKILGDFEDSCC

SEQ ID NO: 12194 - protein, 40 aa, Homo sapiens
MMSSVSTESKLQQAVSLQGVDPETCMIVFKNHWAQVVKIL

SEQ ID NO: 12195 - protein, 1040 aa, Homo sapiens; identical to SEQ ID NO: 12193

SEQ ID NO: 12196 - protein, 60 aa, Homo sapiens
MMSSVSTESKLQQAVSLQGVDPETCMIVFKNHWAQVVKILEKHDPLKNTQAKYGSIPPDE

SEQ ID NO: 12197 - protein, 13 aa, Homo sapiens
MMSSVSTESKLQQ

SEQ ID NO: 12198 - protein, 42 aa, Homo sapiens
MMSSVSTESKLQQAVSLQGVDPETCMIVFKNHWAQVVKILEK

SEQ ID NO: 12199 - protein, 101 aa, Homo sapiens
MFSKFTSILQHAVEALAPSLPLQEDFVYHWKAITHYYIETSDDKAPVTDTNIPSHLEQMLDILVQEENERESGETGPCMEYLLHHKILETLYTLGKADVSS

SEQ ID NO: 12200 - protein, 765 aa, Homo sapiens
MFSKFTSILQHAVEALAPSLPLQEDFVYHWKAITHYYIETSDDKAPVTDTNIPSHLEQMLDILVQEENERESGETGPCMEYLLHHKILETLYTLGKADCPPGMKQQVLVFYTKLLGRIRQPLLPHINVHRPVQKLIRLCGEVLATPTENEEIQFLCIVCAKLKQDPYLVNFFLENKMKSLASKGVPNVISEDTLKGQDSLSTDTGQSRQPEELSGATGMEQTELEDEPPHQMDHLSTSLDNLSVTSLPEASVVCPNQDYNLVNSLLNLTRSPDGRIAVKACEGLMLLVSLPEPAAAKCLTQSTCLCELLTDRLASLYKALPQSVDPLDIETVEAINWGLDSYSHKEDASAFPGKRALISFLSWFDYCDQLIKEAQKTAAVALAKAVHERFFIGVMEPQLMQTSEMGILTSTALLHRIVRQVTSDVLLQEMVFFILGEQREPETLAEISRHPLRHRLIEHCDHISDEISIMTLRMFEHLLQKPNEHILYNLVLRNLEERNYTEYKPLCPEDKDVVENGLIAGAVDLEEDPLFTDISPENTLPNQEWLSSSPPATPDHPKNDGKTEVHKIVNSFLCLVPDDAKSSYHVEGTGYDTYLRDAHRQFRDYCAICLRWEWPGSPKALEKCNLEAAFFEGHFLKVLFDRMGRILDQPYDVNLQVTSVLSRLSLFPHPHIHEYLLDPYVNLAPGCRSLFSVIVRVVGDLMLRIQRIQDFTPKLLLVRKRLLGLEPEGPIIDHITLLEGVIVLEEFCKELAAIAFVKYHASSTP

SEQ ID NO: 12201 - protein, 738 aa, Homo sapiens
MFSKFTSILQHAVEALAPSLPLQEDFVYHWKAITHYYIETSDDKAPVTDTNIPSHLEQMLDILVQEENERESGETGPCMEYLLHHKILETLYTLGKADCPPGMKQQVLVFYTKLLGRIRQPLLPHINVHRPVQKLIRLCGEVLATPTENEEIQFLCIVCAKLKQDPYLVNFFLENKMKSLASKGVPNVISEDTLKGQDSLSTDTGQSRQPEELSGATGMEQTELEDEPPHQMDHLSTSLDNLSVTSLPEASVVCPNQDYNLVNSLLNLTRSPDGRIAVKACEGLMLLVSLPEPAAAKCLTQSTCLCELLTDRLASLYKALPQSVDPLDIETVEAINWGLDSYSHKEDASAFPGKRALISFLSWFDYCDQLIKEAQKTAAVALAKAVHERFFIGVMEPQLMQTSEMGILTSTALLHRIVRQVTSDVLLQEMVFFILGEQREPETLAEISRHPLRHRLIEHCDHISDEISIMTLRMFEHLLQKPNEHILYNLVLRNLEERNYTEYKPLCPEDKDVVENGLIAGAVDLEEDPLFTDISPENTLPNQEWLSSSPPATPDHPKNDGKTEVHKIVNSFLCLVPDDAKSSYHVEGTGYDTYLRDAHRQFRDYCAICLRWEWPGSPKALEKCNLEAAFFEGHFLKVLFDRMGRILDQPYDVNLQVTSVLSRLSLFPHPHIHEYLLDPYVNLAPGCRSLFSVIVRVVGDLMLRIQRIQDFTPKLLLVRKRLLGLEPEGPMQTLPSWW

SEQ ID NO: 12202 - protein, 83 aa, Homo sapiens
LSLFPHPHIHEYLLDPYVNLAPGCRSLFSVIVRVVGDLMLRIQRIQDFTPKLLLVRKRLLGLEPEGPISDLEPVEALTVSSIC

SEQ ID NO: 12203 - protein, 743 aa, Homo sapiens
MLSRLGALLQEAVGAREPSIDLLQAFVEHWKGITHYYIESTDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 12204 - protein, 161 aa, Homo sapiens [sequence omitted]

SEQ ID NO: 12205 - protein, 710 aa, Homo sapiens
MRGENRPIGKRTLPPRAGWIGGCPGSQPDAKARKGWTLAPHSSRCHRCCHYRCHCRCCLCPAEMTVGRPEGAPGGAEGSRQIFPPESFADTEAGEELSGDGLVLPRASKLDEFLSPEEEIDSTSDSTGSIYQNLQELKQKGRWCLLESLFQSDPESDENLSEDEEDLESFFQDKDRGMVQVQCPQALRCGSTRRCSSLNNLPSNIPRPQTQPPSGSRPPSQHRSVSSWASSITVPRPFRMTLREARKKAEWLGSPASFEQERQRAQRQGEEEAECHRQFRAQPVPAHVYLPLYQEIMERSEARRQAGIQKRKELLLSSLKPFSFLEKEEQLKEAARQRDLAATAEAKISKQKATRRIPKSILEPALGDKLQEAELFRKIRIQMRALDMLQMASSPIASSSNRANPQPRTATRTQQEKLGFLHTNFRFQPRVNPVVPDYEGLYKAFQRRAAKRRETQEATRNKPFLLRTANLRHPQRPCDAATTGRRQDSPQPPATPLPRSRSLSGLASLSANTLPVHITDATRKRESAVRSALEKKNKADESIQWLEIHKKKSQAMSKSVTLRAKAMDPHKSLEEVFKAKLKENRNNDRKRAKEYKKELEEMKQRIQTRPYLFEQVAKDLAKKEAEQWYLDTLKQAGLEEDFVRNKGQGTRAVQEKETKIKDFPRFQETTKLSIRDPEQGLEGSLEQPASPRKVLEELSHQSPENLVSLA

SEQ ID NO: 12206 - protein, 647 aa, Homo sapiens
MTVGRPEGAPGGAEGSRQIFPPESFADTEAGEELSGDGLVLPRASKLDEFLSPEEEIDSTSDSTGSIYQNLQELKQKGRWCLLESLFQSDPESDENLSEDEEDLESFFQDKDRGMVQVQCPQALRCGSTRRCSSLNNLPSNIPRPQTQPPSGSRPPSQHRSVSSWASSITVPRPFRMTLREARKKAEWLGSPASFEQERQRAQRQGEEEAECHRQFRAQPVPAHVYLPLYQEIMERSEARRQAGIQKRKELLLSSLKPFSFLEKEEQLKEAARQRDLAATAEAKISKQKATRRIPKSILEPALGDKLQEAELFRKIRIQMRALDMLQMASSPIASSSNRANPQPRTATRTQQEKLGFLHTNFRFQPRVNPVVPDYEGLYKAFQRRAAKRRETQEATRNKPFLLRTANLRHPQRPCDAATTGRRQDSPQPPATPLPRSRSLSGLASLSANTLPVHITDATRKRESAVRSALEKKNKADESIQWLEIHKKKSQAMSKSVTLRAKAMDPHKSLEEVFKAKLKENRNNDRKRAKEYKKELEEMKQRIQTRPYLFEQVAKDLAKKEAEQWYLDTLKQAGLEEDFVRNKGQGTRAVQEKETKIKDFPRFQETTKLSIRDPEQGLEGSLEQPASPRKVLEELSHQSPENLVSLA

SEQ ID NO: 12207 - protein, 325 aa, Homo sapiens
MEGLEENGGVVQVGELLPCKICGRTFFPVALKKHGPICQKTATKKRKTFDSSRQRAEGTDIPTVKPLKPRPEPPKKPSNWRRKHEEFIATIRAAKGLDQALKEGGKLPPPPPPSYDPDYIQCPYCQRRFNENAADRHINFCKEQAARISNKGKFSTDTKGKPTSRTQVYKPPALKKSNSPGTASSGSSRLPQPSGAGKTVVGVPSGKVSSSSSSLGNKLQTLSPSHKGIAAPHAGANVKPRNSTPPSLARNPAPGVLTNKRKTYTESYIARPDGDCASSLNGGNIKGIEGHSPGNLPKFCHECGTKYPVEWAKFCCECGIRRMIL

SEQ ID NO: 12208 - protein, 275 aa, Homo sapiens
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKG

SEQ ID NO: 12209 - protein, 456 aa, Homo sapiens
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKGNKSNTMYKPIFSPEFEFEEEFSRDRREDETWGRSQQNSGPFQFSDYRIQRLKRERLVASNNKIRDPVSEPSVEKFSPPSETPVGALQGSARNSSLSMAPDSSGSSGSIEEPQLGECSHCGRKFLSFRLERHSNICSRMRGSKRKVFDSSRARAKGTELEQYLNWKGPASAKAEPPQKSNWR

SEQ ID NO: 12210 - protein, 92 aa, Homo sapiens
MAGLQRLASHLPVGVMLPHNTTEAPGPHSAKQDSYEQGDSSQQSLKGHLRNNFQKQLLSNKELILDKVYTHPKWNTQTKARSYSYPHCTGIS

SEQ ID NO: 12211 - protein, 171 aa, Homo sapiens
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPR

SEQ ID NO: 12212 - protein, 93 aa, Homo sapiens
MAGLQRLASHLPVGVMLPHNTTEAPGPHSAKQDSYEQGDSSQQSLKGHLRNNFQKQLLSNKELILDKVYTHPKWNTQTKARSYSYPHCTGISQ

SEQ ID NO: 12213 - protein, 161 aa, Homo sapiens
MAGLQRLASHLPVGVMLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDH

SEQ ID NO: 12214 - protein, 275 aa, Homo sapiens
MAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKQGSEELPKEAKGRKDTEKDQVPEPEGQLEEPTLEVVEQASPYSMDDRDPRKFFMSGFTGYVPCARFLFGSSFPVLTNQALQEFGQKHSPGSAQDPKHLPPLPRTYPQNLGLLPNYGGYVPGYKFQFGHTFGHLTHDALGLSTFQKQLLA

SEQ ID NO: 12215 - protein, 216 aa, Homo sapiens
MAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKQGSEELPKEAKGRKDTEKDQVPEPEGQLEEPTLEVVEQASPYSMDDRDPRKFFMSGTAGIWAEALTRQCPGPQTSPPTSQNIPSEPGSFT

SEQ ID NO: 12216 - protein, 317 aa, Homo sapiens
MTTTQKHDLFTPEPHYVPGYAGFFPQLRYQVGNTYGRTTGQLLTDPSVQKSPCSVLSPMSKPKFIEDFSQSKPPRVPCQDLTEPYIPHYTSLKPSKNFEILGQLPPLEVDAQEPPGVENIPRQILLPAGFTPDTPHPPCPPGRKGDSRDLGHPVYGEEAWKSATPVCEAPRQHQLYHCQRDEYPPPARRQQETLDVGSFQRLPQLDHPNLIQRKAISGYAGFIPRFTWVMGLNYRDGVMQAMDEFDKSQFLFRNPHCDLGEKLPGTHWPSNHIYSSQGLIPFYMGFIPAMQDNYALTFGNSTRRAYWKEWAKRNHTL

SEQ ID NO: 12217 - protein, 271 aa, Homo sapiens
MTTTQKHDLFTPEPHYVPGYAGFFPQLRYQVGNTYGRTTGQLLTDPSVQKSPCSVLSPMSKPKFIEDFSQSKPPRVPCQDLTEPYIPHYTSLKPSKNFEILGQLPPLEVDAQEPPGVENIPRQILLPAGFTPDTPHPPCPPGRKGDSRDLGHPVYGEEAWKSATPVCEAPRQHQLYHCQRDEYPPPARRQQETLDVGSFQRLPQLDHPNLIQRKAISEQASGLGGPPLPPSCFQEPSFSQDEAVPCLPVPIWPHQTVANVQGTKGSLAWLP

SEQ ID NO: 12218 - protein, 259 aa, Homo sapiens
MAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKQGSEELPKEAKGRKDTEKDQVPEPEGQLEEPTLEVVEQASPYSMDDRDPRKFFMSAFLCSPTRHCRNLGRSTHQAVPRTPNISPHFPEHTLRTWVFYNYGGYVPGYKFQFGHTFGHLTHDALGLSTFQKQLLA

SEQ ID NO: 12219 - protein, 163 aa, Homo sapiens
MSLGLLKFQAVGEEDEEDEEGESLDSVKALTAKLQLQTRRPSYLEWTAQVQSQAWRRAQAKPGPGGPGDICGFDSMDSALEWLRRELREMQAQDRQLAGQLLRLRAQLHRLKMDQACHLHQELLDEAELELELEPGAGLALAPLLRHLGLTRMNISARRFTLC

SEQ ID NO: 12220 - protein, 244 aa, Homo sapiens
MNPVYSPVQPGAPYGNPKNMAYTGYPTAYPAAAPAYNPSLYPTNSPSYAPEFQFLHSAYATLLMKQAWPQNSSSCGTEGTFHLPVDTGTENRTYQASSAAFRYTAGTPYKVPPTQSNTAPPPYSPSPNPYQTAMYPIRSAYPQQNLYAQGAYYTQPVYAAQPHVIHHTTVVQPNSIPSAIYPAPVAAPRTNGVAMGMVAGTTMAMSAGTLLTTPQHTAIGAHPVSMPTYRAQGTPAYSYVPPHW

SEQ ID NO: 12221 - protein, 235 aa, Homo sapiens
MNPVYSPVQPGAPYGNPKNMAYTGYPTAYPAAAPAYNPSLYPTNSPSYAPATLLMKQAWPQNSSSCGTEGTFHLPVDTGTENRTYQASSAAFRYTAGTPYKVPPTQSNTAPPPYSPSPNPYQTAMYPIRSAYPQQNLYAQGAYYTQPVYAAQPHVIHHTTVVQPNSIPSAIYPAPVAAPRTNGVAMGMVAGTTMAMSAGTLLTTPQHTAIGAHPVSMPTYRAQGTPAYSYVPPHW

SEQ ID NO: 12222 - protein, 129 aa, Homo sapiens
MNPVYSPVQPGAPYGNPKNMAYTGYPTAYPAAAPAYNPSLYPTNSPSYAPATLLMKQAWPQNSSSCGTEGTFHLPVDTGTENRTYQASSAAFSTLLTTPQHTAIGAHPVSMPTYRAQGTPAYSYVPPHW

SEQ ID NO: 12223 - protein, 123 aa, Homo sapiens
MNPVYSPGSSGVPYANAKGIGYPAGFPMGYAAAAPAYSPNMYPGANPTFQTGYTPGTPYKVSCSPTSGAVPPYSSSPNAVPMSPCADQWARQLGQISGQPFVLLAGLLCWPHGEALESLMDCN

SEQ ID NO: 12224 - protein, 195 aa, Homo sapiens
MNPVYSPGSSGVPYANAKGIGYPAGFPMGYAAAAPAYSPNMYPGANPTFQTGYTPGTPYKVSCSPTSGAVPPYSSSPNPYQTAVYPVRSAYPQQSPYAQQGTYYTQPLYAAPPHVIHHTTVVQPNGMPATVYPAPIPPPRGNGVTMGMVAGTTMAMSAGTLLTAHSPTPVAPHPVTVPTYRAPGTPTYSYVPPQW

SEQ ID NO: 12225 - protein, 195 aa, Homo sapiens; identical to SEQ ID NO: 12224

SEQ ID NO: 12226 - protein, 127 aa, Homo sapiens
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQEAYVPLFLPKVTNCQFLIQCF

SEQ ID NO: 12227 - protein, 670 aa, Homo sapiens
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTGSICASFLTQSYQLPVLDTMFLRKKYRGKDFGLHMLEDFVDSFTEDALGLRYPLSSLMYTACKQYFEKYPGDHELLWEVEGVGHWYQRIPVTRALQREALKILALSQNEPKRPMSGEYGPASVPEYEARTEDNQSSEMQLTIDSLKDAFASTSEGHDKTSVSTHTRSGNLKRPKIGKRFQDSEFSSSQGEDEKTSQTSLTASINKLESTARPSESSEEFLEEEPEQRGIEFEDESSDRDARPALETQPQQEKQDGEKESELEPMNGEIMDDSLKTSLITEEEDSTSEVLDEELKLQPFNSSEDSTNLVPLVVESSKPPEVDAPDKTPRIPDSEMLMDEGTSDEKGHMEEKLSLLPRKKAHLGSSDNVATMSNEERSDGGFPNSVIAEFSEEPVSENLSPNTTSSLEDQGEEGVSEPQETSTALPQSSLIEVELEDVPFSQNAGQKNQSEEQSEASSEQLDQFTQSAEKAVDSSSEEIEVEVPVVDRRNLRRKAKGHKGPAKKKAKLT

SEQ ID NO: 12228 - protein, 86 aa, Homo sapiens
MAFPVDMLENCSHEELENSAEDYMSDLRCGDPENPECFSLLNITIPISLSNVGFVPLYGGDQTQKILALFAPEDSLTAVALYLADQ

SEQ ID NO: 12229 - protein, 223 aa, Homo sapiens
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTGSICASFLTQSYQLPVLDTMFLRKKYRGKDFGLHMLEDFVDSFTEDALGLRYPLSSLMYT

SEQ ID NO: 12230 - protein, 175 aa, Homo sapiens
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTGSICASFLTQSY

SEQ ID NO: 12231 - protein, 192 aa, Homo sapiens
MKVQSFGERVVLFILNAIIFGRLERNLDDDDMFFLPHSVKEQAKILWRRGAAVGFYTTKMKGRLCGDGTGACYLLPVFDTVFIRRKHWHRGLGTAMLRDFCETFPEDEALGVSCSMSPAMYQAHPGNSEDVSRHARTSQNDRPRQPAPGDGSKERMCGEELEDTKDDPECGVEEEDAGLAGQPPGKLTRSSP

SEQ ID NO: 12232 - protein, 192 aa, Homo sapiens; identical to SEQ ID NO: 12231

SEQ ID NO: 12233 - protein, 329 aa, Homo sapiens
MKRRQKRKHLENEESQETAEKGGGMSKSQEDALQPGSTRVAKGWSQGVGEVTSTSEYCSCVSSSRKLIHSGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCHVFHLTMAQLTGNMESESTQDEQEEENGNEKEEEEKPEAKEEEGQPTEEDLGLRRSWSQCPGCVFHSPKDRN

SEQ ID NO: 12234 - protein, 282 aa, Homo sapiens
MKRRQKRKHLENEESQETAEKGGGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCHVFHLTMAQLTGNMESESTQDEQEEENGNEKEEEEKPEAKEEEGQPTEEDLGLRRSWSQCPGCVFHSPKDRN

SEQ ID NO: 12235 - protein, 244 aa, Homo sapiens
MKRRQKRKHLENEESQETAEKGGGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCPKMSRRRKMEMRRRRKRNQKQRRRRGSPQKKTLA

SEQ ID NO: 12236 - protein, 330 aa, Homo sapiens
MKRRQKRKHLENEESQETAEKGGGMSKSQEDALQPGSTRVAKGWSQGVGEVTSTSEYCSCVSSSRKLIHSGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCHVFHLTMAQLTGNMESESTQDEQEEENGNEKEEEEKPEAKEEEGQPTEEDLGLRRSWSQCPGCVFHSPKDRNS

SEQ ID NO: 12237 - protein, 283 aa, Homo sapiens
MKCYFTDHRGEQSPTDGTTLSLTSPESTEESVEVFWPGTIQREGSSPRPGPAIPREEGLYFAARDRGMRDWSSSPSSESSEYQSYSQYQSCCSCMCDEDNAAPQSVCAFYTHVQTVRGVAVAWETEAGFEPVTRKPRIHEAQFIKRQRWNGSSFEMASNTDMRWDLEACKSNCSPEPEDIDLLECCLQELREPPDWLVTTNYGVRCVACCRVLPSLDALLEHAQHGIREGFSCQIFFEEMLERRRAQGQAHDQQLEEEQSPSDNSECSRPQGEVLSAQQQEKQ

SEQ ID NO: 12238 - protein, 165 aa, Homo sapiens
MDAPRRDMELLSNSLAAYAHIRANPESFGLYFVLGVCFGLLLTLCLLVISISWAPRPRPRGPAQRRDPRSSTLEPEDDDEDEEDTVTRLGPDDTLPGPELSAEPDGPLNVNVFTSAEELERAQRLEERERILREIWRTGQPDLLGTGTLGPSPTATGTLGRMHYY

SEQ ID NO: 12239 - protein, 236 aa, Homo sapiens
MEVGLPAITLFLTSASSPVVATTMDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 12240 - protein, 213 aa, Homo sapiens
MDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 12241 - protein, 213 aa, Homo sapiens; identical to SEQ ID NO: 12240

SEQ ID NO: 12242 - protein, 76 aa, Homo sapiens
MDQEPVGGVERGEAVAASGAAAAAAFGESAGQMSNERGFENVELGVIGKKKKVPRRVIHFVSGETMEEYSTDEDEV

SEQ ID NO: 12243 - protein, 158 aa, Homo sapiens
MEIDGFQQLDLEKSVPSKKTTPKRIIHFVDGDIMEEYSTEEEEEEEKEEQSTNSTLDPSKLSWGPYLRFWAGRIASTSFSTCEFLGGRFAVFFGLTQPKYQYVLNEFYRIQNKKSDNKSERRGSKAQAAEVPNEKCHLEAGVQEYGTIQQDVTEAIPQ

SEQ ID NO: 12244 - protein, 100 aa, Homo sapiens
MEIDGFQQLDLEKSVPSKKTTPKRIIHFVDGDIMEEYSTEEEEEEEKEEQSTNSTLDPSKLSWGPYLRFWAGRIASTSFSTCEFLGGRFAVFFGLTQPKY

SEQ ID NO: 12245 - protein, 158 aa, Homo sapiens; identical to SEQ ID NO: 12243

SEQ ID NO: 12246 - protein, 99 aa, Homo sapiens
MEIDGFQQLDLEKSVPSKKTTPKRIIHFVDGDIMEEYSTEEEEEEEKEEQSTNSTLDPSKLSWGPYLRFWAGRIASTSFSTCEFLGGRFAVFFGLTQPK

SEQ ID NO: 12247 - protein, 647 aa, Homo sapiens
MAGPQETVLALPLREGVQAAATVPILLYNLEDGLSDHPLDQGPRCPARRPCSPASAPAPTSPKKPKIQAPGETFPTDWSPPPVEFLNPRVLQASREAPAQRWVGVVGPQGLRRLAGELPEELEQEHLDLDPKRGLALPEKLFWNTSGLSQQAAAPEFSWGGSGSYFNNLDYLLQEKREQALEQERERLLLQECLNLNSLDLDEEEVPLTPEHRMLVEKYSVSLQTIPPVHPGETVFLPRCHPLPCILDSSLLKPRSHLEGLFLSSPPAQQLSFLRSGLLNILYLHMPDCPVSLLQWLFQLLTWPPETSLGAFGLLWDLIVDGIFLQPDEDKHLWCPSLQEVREAFHSLGAHSPALYPLGPFWHGGRVLPGEAGLNENEEQDAPQEIALDISLGHIYKFLALCAQAQPGAYTDENLMGLIELLCRTSLDVGLRLLPKVDLQQLLLLLLENIREWPGKLQELCCTLSWVSDHHHNLLALVQFFPDMTSRSRRLRSQLSLVVIARMLGQQEMLPLWQEKTQLSSLSRLLGLMRPSSLRQYLDSVPLPPCQEQQPKASAELDHKACYLCHSLLMLAGVVVSCQDITPDQWGELQLLCMQLDRHISTQIRESPQAMHRTMLKDLATQTYIRWQELLTHCQPQAQYFSPWKDI

SEQ ID NO: 12248 - protein, 119 aa, Homo sapiens
MRPSSLRQYLDSVPLPPCQEQQPKASAELDHKACYLCHSLLMLAGVVVSCQDITPDQWGELQLLCMQLDRHISTQIRESPQAMHRTMLKDLATQTYIRWQELLTHCQPQAQYFSPWKDI

SEQ ID NO: 12249 - protein, 827 aa, Homo sapiens
MAHEREILKGMYEELKEKSHKPDVELIQHRAWRIDMVSTELESFRKASYIESGPEEFYQRFKKCFSATHIFISIKGKDSQNTAHGYLILNRTLHQQLKIKNPFLAPSSEAVRIPATLPHPGALPFPPYVAKASSDELLNLQKPLQSALGFVILRSSQNWNSKNRQRWSRTKAGQMSHGLQMAGPQETVLALPLREGVQAAATVPILLYNLEDGLSDHPLDQGPRCPARRPCSPASAPAPTSPKKPKIQAPGETFPTDWSPPPVEFLNPRVLQASREAPAQRWVGVVGPQGLRRLAGELPEELEQEHLDLDPKRGLALPEKLFWNTSGLSQQAAAPEFSWGGSGSYFNNLDYLLQEKREQALEQERERLLLQECLNLNSLDLDEEEVPLTPEHRMLVEKYSVSLQTIPPVHPGETVFLPRCHPLPCILDSSLLKPRSHLEGLFLSSPPAQQLSFLRSGLLNILYLHMPDCPVSLLQWLFQLLTWPPETSLGAFGLLWDLIVDGIFLQPDEDKHLWCPSLQEVREAFHSLGAHSPALYPLGPFWHGGRVLPGEAGLNENEEQDAPQEIALDISLGHIYKFLALCAQAQPGAYTDENLMGLIELLCRTSLDVGLRLLPKVDLQQLLLLLLENIREWPGKLQELCCTLSWVSDHHHNLLALVQFFPDMTSRSRRLRSQLSLVVIARMLGQQEMLPLWQEKTQLSSLSRLLGLMRPSSLRQYLDSVPLPPCQEQQPKASAELDHKACYLCHSLLMLAGVVVSCQDITPDQWGELQLLCMQLDRHISTQIRESPQAMHRTMLKDLATQTYIRWQELLTHCQPQAQYFSPWKDI

SEQ ID NO: 12250 - protein, 679 aa, Homo sapiens
MWPRLPGAGLAPQLRRQDQRLHFTGQMSHGLQMAGPQETVLALPLREGVQAAATVPILLYNLEDGLSDHPLDQGPRCPARRPCSPASAPAPTSPKKPKIQAPGETFPTDWSPPPVEFLNPRVLQASREAPAQRWVGVVGPQGLRRLAGELPEELEQEHLDLDPKRGLALPEKLFWNTSGLSQQAAAPEFSWGGSGSYFNNLDYLLQEKREQALEQERERLLLQECLNLNSLDLDEEEVPLTPEHRMLVEKYSVSLQTIPPVHPGETVFLPRCHPLPCILDSSLLKPRSHLEGLFLSSPPAQQLSFLRSGLLNILYLHMPDCPVSLLQWLFQLLTWPPETSLGAFGLLWDLIVDGIFLQPDEDKHLWCPSLQEVREAFHSLGAHSPALYPLGPFWHGGRVLPGEAGLNENEEQDAPQEIALDISLGHIYKFLALCAQAQPGAYTDENLMGLIELLCRTSLDVGLRLLPKVDLQQLLLLLLENIREWPGKLQELCCTLSWVSDHHHNLLALVQFFPDMTSRSRRLRSQLSLVVIARMLGQQEMLPLWQEKTQLSSLSRLLGLMRPSSLRQYLDSVPLPPCQEQQPKASAELDHKACYLCHSLLMLAGVVVSCQDITPDQWGELQLLCMQLDRHISTQIRESPQAMHRTMLKDLATQTYIRWQELLTHCQPQAQYFSPWKDI

SEQ ID NO: 12251 - protein, 1019 aa, Homo sapiens
MGTRDDVPEAKVLVPVAVYCGSIPRTSAGPRVLPPGSINSSLPHGEGSLQPEPRALLNNEEPSQLLRGLGQLGGLKLDTPSKGWQARNGHPRNLRALSLGDQPLVLLPSPESEANSVARDTIQIKDKLKKRRLSEGLAASSRASLDPGGGPQGVPLHSTIPRATSQRLLRVPRPMPLIQSIPTTPEASGVKEKGLDLPGSIPGPHELRPGAQEAQISWQYLHCNDEKMQKSLGAIVIPPIPKARTVAATPSRVPGSLPSPLPPGQGVLTGLRAPRTRLARGSGPREKTPASLEPKPLASPIRDRPAAAKKPALPFSQSAPTLTAFSFDCAREACPPLKEEDQKEIGTKIQVTISKSAREKMQLKQMKEMELLRRLEEPRTGQELTSQCLGSQRAFMKEGLLPLRGSGTLSVPTRLSGPCRNDVSIILRKWASRASLPSIPISRQEPRFARHASANSLPAVLTLGSPEWEEEEEMDLRACKELRPFSNPELGLRDALQCLNSSDWQMKEKGLVSIQRLAACHSEVLTGKLHDVCLVVTGEVTNLRSKVSHLAISTLGDLFQALKKNMDQEAEEIARCLLQKMADTNEFIQRAAGQSLRAMVENVTLARSLVVLTSAGVYHRNPLIRKYAAEHLSAVLEQIGAEKLLSGTRDSTDMLVHNLVRLAQDSNQDTRFYGRKMVNILMANTKFDAFLKQSLPSYDLQKVMAAIKQQGIEDNDELPSAKGRKVLRSLVVCENGLPIKEGLSCNGPRLVGLRSTLQGRGEMVEQLRELTRLLEAKDFRSRMEGVGQLLELCKAKTELVTAHLVQVFDAFTPRLQDSNKKVNQWALESFAKMIPLLRESLHPMLLSIIITVADNLNSKNSGIYAAAVAVLDAMVESLDNLCLLPALAGRVRFLSGRAVLDVTDRLAVLVASVYPRKPQAVERHVLPILWHFLNTATRNGTLPGPSGNIRGVVCRLSRSLQEHMGSRLLDFAASQPKHVLKTLQELLDSESLGGSRKATDRGVAPDSKTTGSSYPFQLD

SEQ ID NO: 12252 - protein, 964 aa, Homo sapiens
MGTRDDVPEAKVLVPVAVYCGSIPRTSAGPRVLPPGSINSSLPHGEGSLQPEPRALLNNEEPSQLLRGLGQLGGLKLDTPSKGWQARNGHPRNLRALSLGDQPLVLLPSPESEANSVARDTIQIKDKLKKRRLSEGLAASSRASLDPGGGPQGVPLHSTIPRATSQRLLRVPRPMPLIQSIPTTPEASGVKEKGLDLPGSIPGPHELRPGAQEAQISWQYLHCNDEKMQKSLGAIVIPPIPKARTVAATPSRVPGSLPSPLPPGQGVLTGLRAPRTRLARGSGPREKTPASLEPKPLASPIRDRPAAAKKPALPFSQSAPTLTAFSFDCAREACPPLKEEDQKEIGTKIQVTISKSAREKMQLKQMKEMELLRRLEEPRTGQELTSQCLGSQRAFMKEANSLPAVLTLGSPEWEEEEEMDLRACKELRPFSNPELGLRDALQCLNSSDWQMKEKGLVSIQRLAACHSEVLTGKLHDVCLVVTGEVTNLRSKVSHLAISTLGDLFQALKKNMDQEAEEIARCLLQKMADTNEFIQRAAGQSLRAMVENVTLARSLVVLTSAGVYHRNPLIRKYAAEHLSAVLEQIGAEKLLSGTRDSTDMLVHNLVRLAQDSNQDTRFYGRKMVNILMANTKFDAFLKQSLPSYDLQKVMAAIKQQGIEDNDELPSAKGRKVLRSLVVCENGLPIKEGLSCNGPRLVGLRSTLQGRGEMVEQLRELTRLLEAKDFRSRMEGVGQLLELCKAKTELVTAHLVQVFDAFTPRLQDSNKKVNQWALESFAKMIPLLRESLHPMLLSIIITVADNLNSKNSGIYAAAVAVLDAMVESLDNLCLLPALAGRVRFLSGRAVLDVTDRLAVLVASVYPRKPQAVERHVLPILWHFLNTATRNGTLPGPSGNIRGVVCRLSRSLQEHMGSRLLDFAASQPKHVLKTLQELLDSESLGGSRKATDRGVAPDSKTTGSSYPFQLD

SEQ ID NO: 12253 - protein, 69 aa, Homo sapiens
MGTRDDVPEAKVLVPVAVYCGSIPRTSAGPRVLPPGSINSSLPHGEGSLQPEPRALLNNEEPSQLLRGL

SEQ ID NO: 12254 - protein, 1720 aa, Homo sapiens
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 12255 - protein, 995 aa, Homo sapiens
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEVRHISNIWVKTLSNKTFFCKEKNFSYC

SEQ ID NO: 12256 - protein, 1160 aa, Homo sapiens
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNFIIS

SEQ ID NO: 12257 - protein, 343 aa, Homo sapiens
MKLLQMLLRGNPCCPQPEISPQGSSVPFLGAAGHQQSLPSSWKASCSGPLVMASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 12258 - protein, 354 aa, Homo sapiens
MPLEERRSSGERNDAAPTNHRRPGEKRASTAKQVSSVPFLGAAGHQQSLPSSWKASCSGPLVMASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 12259 - protein, 232 aa, Homo sapiens
MASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALP

SEQ ID NO: 12260 - protein, 292 aa, Homo sapiens
MASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 12261 - protein, 292 aa, Homo sapiens; identical to SEQ ID NO: 12260

SEQ ID NO: 12262 - protein, 426 aa, Homo sapiens
MAVQAALLSTHPFVPFGFGGSPDGLGGAFGALDKGCCFEDDETGAPAGALLSGAEGGDVREATRDLLSFIDSASSNIKLALDKPGKSKRKVNHRKYLQKQIKRCSGLMGAAPPGPPSPSAADTPAKRPLAAPSAPTVAAPAHGKAAPRREASQAAAAASLQSRSLAALFDSLRHVPGGAEPAGGEVAAPAAGLGGAGTGGAGGDVAGPAGATAIPGARKVPLRARNLPPSFFTEPSRAGGGGCGPSGPDVSLGDLEKGAEAVEFFELLGPDYGAGTEAAVLLAAEPLDVFPAGASVLRGPPELEPGLFEPPPAVVGNLLYPEPWSVPGCSPTKKSPLTAPRGGLTLNEPLSPLYPAAADSPGGEDGRGHLASFAPFFPDCALPPPPPPHQVSYDYSAGYSRTAYSSLWRSDGVWEGAPGEEGAHRD

SEQ ID NO: 12263 - protein, 154 aa, Homo sapiens
MQGIDRWIPSIPPLQNHSAVNRRHFSAPQKLHADCEKEMLDGGVPGTTVRVSFDFSCLEMVRELWMWNVEEEEHEVGISTWGGQHCGCPAKSLPGPHPGGVSAPQSASQLMVKLLVWQKSVHKLRKIAAQSEEWSCVLNKISTHPFVSKEHDGT

SEQ ID NO: 12264 - protein, 77 aa, Homo sapiens
MVRELWMWNVEEEEHEVGISTWGGQHCGCPAKSLPGPHPGGVSAPQSASQLMVKLLVWQKSVHKLRKNRNAYSCGPL

SEQ ID NO: 12265 - protein, 77 aa, Homo sapiens
MVRELWMWNVEEEEHEVGICTWGGQHCGCPAKSLPGPHPGGVSAPQSASQLMVKLLVWQKSVHKLRKNRNAYSCGPL

SEQ ID NO: 12266 - protein, 134 aa, Homo sapiens
MAGHPKEKVIPDEVHQNQILRELYLKELRTQKLYTQYHVNPLRKIHTVTRKPMSWHDNLEEPADARFLNLIHHAAQGPRKKYPETQTENQEVGWDLEPLINPERHDRRLNHFRVCSDITLYKAKTWGLGDDHHK

SEQ ID NO: 12267 - protein, 1140 aa, Homo sapiens
MATPGMSWQQHYYGGSAAKFAPSPATAQLAGHSMDYSQEMHLKMSKKIAQLTKVIYALNTKNDEHESAIQALKDAHEEEIQQILAETREKILQYKSKVTEELDLRRKIQVLESSLEDHIKMKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 12268 - protein, 971 aa, Homo sapiens
MKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 12269 - protein, 1060 aa, Homo sapiens
MASALNSKINPPGTCQGSKADGGAGWRMDCDPQMHVKMCKKIAQLTKVIYALNTRQDEAEASMEALREAHQEELQNAVAETKARLLQEQGCAEEEALLQRIQALESALELQKRLTEEALAESASCRLETKERELRVEAEHAERVLTLSREMLELKADYERRLQHLTSHEATPQGRLPQESPETKSEPGQGPEMQEVLLEVQRLRVENQQLSKDYARKAEELQATYERENEAIRQAMQQSVSQALWQWQEKESDLRKNFQVQESALQAQVRKLEGDLEHRGRKISDLKKYAQKLKERIQDLDVQLKEARQENSELKGTAKKLGEKLAVAKDRMMLQECRGTQQTDAMKTELVSENKVLREENDLEAGNLHPQQDQSCLKECPCMKGGTDMQTKKEASAETEYMKQQYEEDLRKIKHQTEEEKKHLKDQLVKRLEDLVKKHTVEIKSVRSSVEAERKKLQREVEAQLEEVRKKSEKEIKQLEEEKAALNVKLQNSLLEVLRLEEFIQQNKTRPTGAEESPQELGRQHCSILETQDPCLKLDETSPRGEEYQDKLAAEEGTSSDEEERTKVLLKEGSDPQPPLGSLLKEKTSKIQRLEEDWQSQKAKLQAQVSQMQQALEQCTSNYREDLQALKQLSDLEREKLQRELQETTQQNHAMKAQLEASHQRALRMLEKARHQELKATEERLKKESSHSLQIQHQTHRLELQALEEKARQELQEERERMQAQQALLLESLRQELSEQQAACSGHQKDLEALQAELRALGRQQASSQCPGDSKDHIIATEERGGPGQAGSPPGAAGQGSGEGCGLWEENAQLQDAVRRLRAEVEQHQQEAQKLRDQRRFLEETQQAQRAREVETLRQEHRKEMQAMVADFSSAQAQLQARLAALEAELKDSGEKPGKGASRPEDLQLIGRLQTRLKEREDIIKQLTEERRFHYAAFPSAMSHRNRSFSFNPHPGYLTPSMKKKKVEDVPSRVVSVPNLASYAKNFLSGDLSSRINAPPITTSPSLDPSPSCGRTYKPNQSTDAKTATRTPDGETAQAKEVQQKQGSPHQEWFTKYFSF

SEQ ID NO: 12270 - protein, 275 aa, Homo sapiens
MLAPCSGWELGCFRLCLRQVRLWAGAGRWACWACQARPYSSGGSERWPGSETEVPPPGPGRRTLKEWTLQGQKLHVQTKGGKVICLGTVYGNIDIHASDKSAVTIDKLQGSSVTVSTEDGLLKAKYLYTESSFLSSAAGDITLGSVHGNITLQSKMGNITVDSSSGCLKASTNQGAIDVYVSQLGKVELKSHKGSIIVKVPSSLQAHLQLSGKEVDVNSEVHVQEMAEVRKDDVVTVTGLMNQASKREKWIKADAPKGTVSFRRQSWFQSLKLQD

SEQ ID NO: 12271 - protein, 392 aa, Homo sapiens
MLAPCSGWELGCFRLCLRQVRLWAGAGRWACWACQARPYSSGGSERWPGSETEVPPPGPGRRTLKEWTLQVSPFGRLRARLPCHLAVRPLDPLTYPDGDRVLVAVCGVEGGVRGLDGLQVKYDEDLEEMAIVSDTIHPQASVEVNAPLKFGLDIKSSGSGCVKVQSIEGDNCKIETEHGTSILQSVKGQKLHVQTKGGKVICLGTVYGNIDIHASDKSAVTIDKLQGSSVTVSTEDGLLKAKYLYTESSFLSSAAGDITLGSVHGNITLQSKMGNITVDSSSGCLKASTNQGAIDVYVSQLGKVELKSHKGSIIVKVPSSLQAHLQLSGKEVDVNSEVHVQEMAEVRKDDVVTVTGLMNQASKREKWIKADAPKGTVSFRRQSWFQSLKLQD

SEQ ID NO: 12272 - protein, 299 aa, Homo sapiens
MFRTPSQANRLALVSANPDLRLLFDLRRHSGQVDWPWQVTLPVAEGVDTAGLDIKSSGSGCVKVQSIEGDNCKIETEHGTSILQSVKGQKLHVQTKGGKVICLGTVYGNIDIHASDKSAVTIDKLQGSSVTVSTEDGLLKAKYLYTESSFLSSAAGDITLGSVHGNITLQSKMGNITVDSSSGCLKASTNQGAIDVYVSQLGKVELKSHKGSIIVKVPSSLQAHLQLSGKEVDVNSEVHVQEMAEVRKDDVVTVTGLMNQASKREKWIKADAPKGTEWSRSHILLSQASRCLAASTFSP

SEQ ID NO: 12273 - protein, 2351 aa, Homo sapiens
MFFKMKNEIDNDPESEKCIKDSTIMRREPQNILSPLMLPNLEIPFSVKDIISRIERAQLHRAREDIDMQLSEIMNNVHRIMTRYTLVFNSSSERNVSLTEHKKKQRTNFLEKMATYAKTIEIREKTLANILAWLEEWNDVLSEMTLMDVDEHHHWIAQMELLPDTLKAIENNVKILSRFSTSFLDEKKKQKKKILSRGTLWKSWKERVIKRPSTARALRPDQMISDQLATNTKVSEIQGMLQELIGTTMFSTLENNAIKYISSTIVNLSTALSMLNDELKCVNFQSSTVYAHETSEAEKELSLKIIRDLSNENEMLQQKLQDAEEKCEQLIRSKIVIEQLYAKLSTSSTLKVLPGPSPQSSRAIIKVGDTEDNMDNILDKELENIVDEVQRKETKDSGIKWDSTISYTAQAERTPDLTELRQQPVASEDISEDSTKDNVSLKKGDFYQEDETDEYQSWKRSHKKATYVYETSGPNLSDNKSGQKVSEAKPSQYYELQVLKKKRKEMKSFSEDKSKSPTEAKRKHLSLTETKSQGGKSGTSMMMLEQFRKVKRESPFDKRPTAAEIKVEPTTESLDKEGKGEIRSLVEPLSMIQFDDTAEPQKGKIKGKKHHISSGTITSKEEKTEEKEELTKQVKSHQLVKSLSRVAKETSESTRVLESPDGKSEQSNLEEFQEAIMAFLKQKIDNIGKAFDKKTVPKEEELLKRAEAEKLGIIKAKMEEYFQKVAETVTKILRKYKDTKKEEQVGEKPIKQKKVVSFMPGLHFQKSPISAKSESSTLLSYESTDPVINNLIQMILAEIESERDIPTVSTVQKDHKEKEKQRQEQYLQEGQEQMSGMSLKQQLLGERNLLKEHYEKISENWEEKKAWLQMKEGKQEQQSQKQWQEEEMWKEEQKQATPKQAEQEEKQKQRGQEEEELPKSSLQRLEEGTQKMKTQGLLLEKENGQMRQIQKEAKHLGPHRRREKGKEKQKPERGLEDLERQIKTKDQMQMKETQPKELEKMVIQTPMTLSPRWKSVLKDVQRSYEGKEFQRNLKTLENLPDEKEPISITPPPSLQYSLPGALPISGQPLTKCIHLTPQQAQEVGITLTPQQAQAQGITLTLQQAQELGIPLTPQQAQALEILFTPQQAQALGIPLTPQQTQVQGITLTPQQDQAPGISLTTQQAQKLGIPLTPQQAQALGIPLTPQQAQELGIPLTPQQAQALRVSLTPQQAQELGIPLTPQQAQALGITLTLQQAQQLGIPLTPQQAQALGITLTPKQVQELGIPLTPQQAQALGITLTPKQAQELGIPLNPQQAQTLGIPLTPKQAQALGIPFTPQQAQALGIPLTPQQAQTQEITLTPQQAQALGMPLTTQQAQELGIPLTPQHAQALGMPLTTQQAQELGIPLTPQQAQALGMPLTTQQAQELGIPLTPQQAQELGIPFTPQQAQAQEITLTPQQAQALGMPLTAQQAQELGITLTPQQAQELGIPLTPQQAQALGIPLIPPQAQELGIPLTPQQAQALGILLIPPQAQELGIPLTPQQAQALGIPLIPPQAQELGIPLTPQQVQALGIPLIPPQAQELEIPLTPQQAQALGIPLTPQQAQELGIPLTPQQAQELGIPLTPQQAQAQGIPLTPQQAQALGISLTPQQAQAQGITLTPQQAQALGVPITPVNAWVSAVTLTSEQTHALESPMNLEQAQEQLLKLGVPLTLDKAHTLGSPLTLKQVQWSHRPFQKSKASLPTGQSIISRLSPSLRLSLASSAPTAEKSSIFGVSSTPLQISRVPLNQGPFAPGKPLEMGILSEPGKLGAPQTLRSSGQTLVYGGQSTSAQFPAPQAPPSPGQLPISRAPPTPGQPFIAGVPPTSGQIPSLWAPLSPGQPLVPEASSIPGDLLESGPLTFSEQLQEFQPPATAEQSPYLQAPSTPGQHLATWTLPGRASSLWIPPTSRHPPTLWPSPAPGKPQKSWSPSVAKKRLAIISSLKSKSVLIHPSAPDFKVAQVPFTTKKFQMSEVSDTSEETQILRDTFAIESFRTFQSHFTKYRTPVYQTPYTDERALLTLMKPTTSPSSLTTLLRTSQISPLEWYQKSRFPPIDKPWILSSVSDTKKPKVMVPPSSPQELEEKRYFVDVEAQKKNLILLNQAIKTCGLPSQLHTMARTLIIEILHMDTVQLGYLFRKYIAYRLIQHARNNIMKRLKAIQNTGKGYEARNLHMMLSRLDDYGKKVMQVWTEKQKSLGQKRNQCLKKMIHVFNQLKKIHELNLSQPIPLIIEEKQIPASTTFVQKPFLKLLMEEDRTSDICKKFRQQEDQTEAIWNVDLSTSSYPIAEKTSMHSLWAQLGGYPDIPRLLQLEVQSTFRKSLASLQSRVKKIPK

SEQ ID NO: 12274 - protein, 359 aa, Homo sapiens
MSEVSDTSEETQILRDTFAIESFRTFQSHFTKYRTPVYQTPYTDERALLTLMKPTTSPSSLTTLLRTSQISPLEWYQKSRFPPIDKPWILSSVSDTKKPKVMVPPSSPQELEEKRYFVDVEAQKKNLILLNQAIKTCGLPSQLHTMARTLIIEILHMDTVQLGYLFRKYIAYRLIQHARNNIMKRLKAIQNTGKGYEARNLHMMLSRLDDYGKKVMQVWTEKQKSLGQKRNQCLKKMIHVFNQLKKIHELNLSQPIPLIIEEKQIPASTTFVQKPFLKLLMEEDRTSDICKKFRQQEDQTEAIWNVDLSTSSYPIAEKTSMHSLWAQLGGYPDIPRLLQLEVQSTFRKSLASLQSRSSG

SEQ ID NO: 12275 - protein, 893 aa, Homo sapiens
MEKDDPPQLVTPTSVKAIILRIEAAQLTRAQEDISTQLSDILDNVNCVINRFQEELGYDLKENAKSQQRDPKGKKRFILLEKIASFSKDAMMKEKHLYDILRWLGDWGDTLTYEIGPRKSEEEAAALDEWIEVTEKVLPLSLIATKRGIESLTALCSTLIEGQKKRSQVSKRTFWQGWQGRSPQTSPSHPQPLSPEQMLQDQHTMNTKASEVTSMLQELLDSTMFSKGEVRAIRYMATVVENLNKALILQHKENRSLETKYRHLQMQATKELSSQRLHFQQFMEVLESRRDALLKQVEILGGRYHDLLLMKQALEFQLKKAQNATGQAEDLAEVSVDSPGPSERETLPRKETVMEESQQEPMKEEQLFSPLPPSPMAMIRDSGAIAAGHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 12276 - protein, 506 aa, Homo sapiens
GHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 12277 - protein, 781 aa, Homo sapiens
MMKEKHLYDILRWLGDWGDTLTYEIGPRKSEEEAAALDEWIEVTEKVLPLSLIATKRGIESLTALCSTLIEGQKKRSQVSKRTFWQGWQGRSPQTSPSHPQPLSPEQMLQDQHTMNTKASEVTSMLQELLDSTMFSKGEVRAIRYMATVVENLNKALILQHKENRSLETKYRHLQMQATKELSSQRLHFQQFMEVLESRRDALLKQVEILGGRYHDLLLMKQALEFQLKKAQNATGQAEDLAEVSVDSPGPSERETLPRKETVMEESQQEPMKEEQLFSPLPPSPMAMIRDSGAIAAGHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARLLALCLRGLVAELALVMEDFDLLHVL

SEQ ID NO: 12278 - protein, 117 aa, Homo sapiens
  MOD_RES (1)..(1): Any amino acid
XCLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 12279 - protein, 413 aa, Homo sapiens
MHLALTTVLLWAWGLQAFEIVEKENIFQRTPCPAFLMFENAAYLADMSFELPCHCKPEEVPAVVWFYQKHLGSSHTKVLTDFDGRVLTEAAQVRVGSDMLTRFSIRMFSLLVFRAQSEDSGLYFCGTRKGDYFYAYDVDIQNSEGMVATFQDKGQEPFADEYYGHLHVFTTFWEWTPCDRCGVRGEQWRIGLCYLQSPDLSPRYLKAVPDVVSCGSRAVPRKLRTKARDHTPEVLVRSCLVPCEKTKTIREGVLAIINYVSKVGSRPWVPQVPIQFHQQRLGHGLIISCPGARPEHAVAWDKDRQHLYRTQYLKGVNRSMRVFIDHGNQLHIRFTQLDDRGIYYCWRQGVLVAGFRLGVTSHGHYPASFSDPETRSAVELTLIGYLLITAVFVTIHFCRCCCYLFHCCPSFSP

SEQ ID NO: 12280 - protein, 413 aa, Homo sapiens; identical to SEQ ID NO: 12279

SEQ ID NO: 12281 - protein, 757 aa, Homo sapiens
MDSLFVEEVAASLVREFLSRKGLKKTCVTMDQERPRSDLSINNRNDLRKVLHLEFLYKENKAKENPLKTSLELITRYFLDHFGNTANNFTQDTPIPALSVPKKNNKVPSRCSETTLVNIYDLSDEDAGWRTSLSETSKARHDNLDGDVLGNFVSSKRPPHKSKPMQTVPGETPVLTSAWEKIDKLHSEPSLDVKRMGENSRPKSGLIVRGMMSGPIASSPQDSFHRHYLRRSSPSSSSTQPQEESRKVPELFVCTQQDILASSNSSPSRTSLGQLSELTVERQKTTASSPPHLPSKRLPPWDRARPRDPSEDTPAVDGSTDTDRMPLKLYLPGGNSRMTQERLERAFKRQGSQPAPVRKNQLLPSDKVDGELGALRLEDVEDELIREEVILSPVPSVLKLQTASKPIDLSVAKEIKTLLFGSSFCCFNEEWKLQSFSFSNTASLKYGIVQNKGGPCGVLAAVQGCVLQKLLFEGDSKADCAQGLQPSDAHRTRCLVLALADIVWRAGGRERAVVALASRTQQFSPTGKYKADGVLETLTLHSLTCYEDLVTFLQQSIHQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTKWKGASVNWNGSDPIL

SEQ ID NO: 12282 - protein, 650 aa, Homo sapiens
MMPSPSDSSRSLTSRPSTRGLTHLRLHRPWLQALLTLGLVQVLLGILVVTFSMVASSVTTTESIKRSCPSWAGFSISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTQLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 12283 - protein, 900 aa, Homo sapiens
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSVCREDSYHSVVSCAAVVLTPMEPMIEMKKREEPEFPEPSKQNLSLKLTKDVDQEARCSHISRMPNSPSADWPLQGVEENGGIDSLPFRLMLQDCTAVKTLLLKMKRVLQESADMSPASSTTSLPVSPLTEEPVPFKDIMKDECSMLKLQLKEKDELISQLQEELGKVRHLQKAFASRVDKSTQTELLCYDGLNLKRLETVQGGREATYRNRIVSQNLSTRDRKAIHTPTEDRFRYSAADQTSPYKNKTCQLPSLCLSNFLKDKELAEVIKHSRGTYETLTSDVTQNLRATVGQSSLKPTAKTEGLSTFLEKPKDQVATARQHSTFTGRFGQPPRGPISLHMYSRKNVFLHHNLHSTELQTLGQQDG

SEQ ID NO: 12284 - protein, 677 aa, Homo sapiens
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSVCREDSYHSVVSCAAVVLTPMEPMIEMKKREEPEFPEPSKQNLSLKLTKDVDQEARCSHISRMPNSPSADWPLQGVEENGGIDSLPFRLMLQDCTAVKTLLLKMKRVLQESADMSPASSTTSLPVSPLTEEPVPFKTTYPREF

SEQ ID NO: 12285 - protein, 677 aa, Homo sapiens
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSVCREDSYHSVVSCAAVVLTPMEPMIEMKKREEPEFPEPSKQNLSLKLTKDVDQEARCSHISRMPNSPSADWPLQGVEENGGIDSLPFRLMLQDCTAVKTLLLKMKRVLQESADMSPASSTTSLPVSPLTEEPVPFKDYYKRPF

SEQ ID NO: 12286 - protein, 900 aa, Homo sapiens; identical to SEQ ID NO: 12283

SEQ ID NO: 12287 - protein, 834 aa, Homo sapiens
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPGGYSAPSFSPWQGSFQGIPRTVPPHRRQTSSTTAFQQPSQTHRSHPGKTNKATTYRGPQ

SEQ ID NO: 12288 - protein, 1047 aa, Homo sapiens
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPPQVLQPSSSLPRPTDHTQGKLIKPQRIEARSECSIQDMHQGGAHPEESFTHVLHQESNYGLEEQPFSSGPQLTMDVAKSTPSEANLNITVNAQEPYHLANNQISDMQFIPTSLQTPPESSTVDQAKRVGRNQSPPVGYMSQPKSLQLLKPSILSSLVPPPVSESSPSRTPTCKKSPIITTCNSAKLQPTSSQTNLANNQNLKASKLRPPSGSFKQKQTNSPQLEPQSFQAKTSIPRPLTQRKEIMQNPNGNLHSGDCLASNRYSRLPKPKIH

SEQ ID NO: 12289 - protein, 261 aa, Homo sapiens
MNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPGGYSAPSFSPWQGSFQGIPRTVPPHRRQTSSTTAFQQPSQTHRSHPGKTNKATTYRGPQ

SEQ ID NO: 12290 - protein, 1246 aa, Homo sapiens
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQDLQTSVNKSIDTGTLVQSWLRGAAMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRFCLDSARQTRQRLSINWSNFSLKKATFAAH

SEQ ID NO: 12291 - protein, 1211 aa, Homo sapiens
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRDGVSPHCPGWSRTPGLK

SEQ ID NO: 12292 - protein, 822 aa, Homo sapiens
MTRRRSRPSGGAGRRERARAAGPQKPQAPEPPPPPSLEAGAGAGPPEAPAEPDHDGPREDDEPNLVPGPQVPPASSQPVQTCCLLCHRERKGWEEGPSQNGLVLQGEKLPPDFMPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPSGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 12293 - protein, 1265 aa, Homo sapiens
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDGVSLLLPSLGYNGAILAHCNLRLPGSSDCAASASQVVGITDDVFLPKDIDLDSVDMDETEREVEYFKRFCLDSARQTRQRLSINWSNFSLKKATFAAH

SEQ ID NO: 12294 - protein, 1224 aa, Homo sapiens
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRFCLDSARQTRQRLSINWSNFSLKKATFAAH

SEQ ID NO: 12295 - protein, 43 aa, Homo sapiens
MKVRLLRQLSAAAKVKAPSGLQGPPQAHQFISLLLEEYGALCQ

SEQ ID NO: 12296 - protein, 1006 aa, Homo sapiens
MTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNK

SEQ ID NO: 12297 - protein, 1211 aa, Homo sapiens; identical to SEQ ID NO: 12291

SEQ ID NO: 12298 - protein, 448 aa, Homo sapiens
MKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPSGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 12299 - protein, 789 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPSGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 12300 - protein, 663 aa, Homo sapiens
MAHLRSPSGFGDPGKKDQKESEEELEEEEEEEEVEEEEEEVEEEEEEVEEEEEEVVEEELVGEEQELEAPETFSEEYLWKVTDIGDYDDDFPDVRPRLASIVSPSLTSTFVPSQSATSTETPSASPPSSTSSHKSFPKIFQTFRKDMSEMSIDRNIHRNLSPGIPVSVQTEESWLQDLSDKVQSRKKASKEKAEPECLASKLREKWVINPEESKLNILYELEFKEDFITLFEPSLRTLPSIGPPSILAYKEESSNLGINFKDEEEETSPKCEFCGSDLRAFFSNVDVSSEPKGHASCCIAFQNLIDYIYEEQIKTKPPKAELIAIDPHAAHGSEVDRLKAKEKALQRKQEQRMARHFAIISREQTHFSEDDSKRLKTISYQLSVDIPEKQIIDDIVFDFQLRNSNMSIICCDSRIACGKVVRNELLEKHYKHGSKFLTSFPDGTTQIFYPSGNLAIIRVPNKVNGFTCIVQEDMPTNPAILAVLDSSGRSSCYHPNGNVWVYINILGGQYSDQAGNRIRAWNWSNSITSSPFVSFKPVFLALNRYIGVRILEQDKISITFLAMGQQARISVGTKVKLPNPEEIPILRYVSGDDLLLLASLIKIRRLFHKLEGCVNFPSSQVWEKLKQPSYLSSLSLKLIALCHSSGIKQDIMKTIRNIINEEI

SEQ ID NO: 12301 - protein, 621 aa, Homo sapiens
MAHLRSPSGFGDPGKKDQKESEQELEAPETFSEEYLWKVTDIGDYDDDFPDVRPRLASIVSPSLTSTFVPSQSATSTETPSASPPSSTSSHKSFPKIFQTFRKDMSEMSIDRNIHRNLSPGIPVSVQTEESWLQDLSDKVQSRKKASKEKAEPECLASKLREKWVINPEESKLNILYELEFKEDFITLFEPSLRTLPSIGPPSILAYKEESSNLGINFKDEEEETSPKCEFCGSDLRAFFSNVDVSSEPKGHASCCIAFQNLIDYIYEEQIKTKPPKAELIAIDPHAAHGSEVDRLKAKEKALQRKQEQRMARHFAIISREQTHFSEDDSKRLKTISYQLSVDIPEKQIIDDIVFDFQLRNSNMSIICCDSRIACGKVVRNELLEKHYKHGSKFLTSFPDGTTQIFYPSGNLAIIRVPNKVNGFTCIVQEDMPTNPAILAVLDSSGRSSCYHPNGNVWVYINILGGQYSDQAGNRIRAWNWSNSITSSPFVSFKPVFLALNRYIGVRILEQDKISITFLAMGQQARISVGTKVKLPNPEEIPILRYVSGDDLLLLASLIKIRRLFHKLEGCVNFPSSQVWEKLKQPSYLSSLSLKLIALCHSSGIKQDIMKTIRNIINEEI

SEQ ID NO: 12302 - protein, 696 aa, Homo sapiens
MSAENNQLSGASPPHPPTTPQYSTQNLPSEKEDTEVELDEESLQDESPFSPEGESLEDKEYLEEEEDLEEEEYLGKEEYLKEEEYLGKEEHLEEEEYLEKAGYLEEEEYIEEEEYLGKEGYLEEEEYLGKEEHLEEEEYLGKEGYLEKEDYIEEVDYLGKKAYLEEEEYLGKKSYLEEEKALEKEENLEEEEALEKEENLDGKENLYKKYLKEPKASYSSQTMLLRDARSPDAGPSQVTTFLTVPLTFATPSPVSESATESSELLLTLYRRSQASQTDWCYDRTAVKSLKSKSETEQETTTKLAPEEHVNTKVQQKKEENVLEFASKENFWDGITDESIDKLEVEDLDENFLNSSYQTVFKTIIKEMAAHNELEEDFDIPLTKLLESENRWKLVIMLKKNYEKFKETILRIKRRREAQKLTEMTSFTFHLMSKPTPEKPETEEIQKPQRVVHHRKKLERDKEWIQKKTVVHQGDGKLILYPNKNVYQILFPDGTGQIHYPSGNLAMLILYAKMKKFTYIILEDSLEGRIRALINNSGNATFYDENSDIWLNLSSNLGYYFPKDKRQKAWNWWNLNIHVHAPPVQPISLKINEYIQVQIRSQDKIIFCFTYEQKQICLNLGTRYKFVIPEVLSEMKKKTILEAEPGPTAQKIRVLLGKMNRLLNYATTPDLENFIEAVSISLMDNKYLKKMLSKLWF

SEQ ID NO: 12303 - protein, 160 aa, Homo sapiens
MYTITKGPSKLVAQRRTGPTQQQVEGRLGELLKCRQPAPPTSQPPRAQPFAQPPGPWPLSSPGPRLVFNRVNGRRAPSTSPSFEGTQETYTVAHEENVRFVSEAWQQVQQQLDGGPAGEGGPRPVQYVERTPNPRLQNFVPIDLDEWWAQQFLARITSCS

SEQ ID NO: 12304 - protein, 194 aa, Homo sapiens
MYTITKGPSKLVAQRRTGPTQQQVEGRLGELLKCRQPAPPTSQPPRAQPFAQPPGPWPLSSPGPRLVFNRVNGRRAPSTSPSFEGTQETYTVAHEENVRFVSEAWQQVQQQLDGGPAGEGGPRPVQYVERTPNPRLQNFVPIDLDEWWAAVPGENHQLFLVAAGRGRCYTADLSPGEKHGALPTHCAWLGAGHT

SEQ ID NO: 12305 - protein, 97 aa, Homo sapiens
MTSSPVSRVVYNGKRTSSPRSPPSSSEIFTPAHEENVRFIYEAWQGVERDLRGQVPGGERGLVEEYVEKVPNPSLKTFKPIDLSDLKRRSTQDAKKS

SEQ ID NO: 12306 - protein, 97 aa, Homo sapiens; identical to SEQ ID NO: 12305

SEQ ID NO: 12307 - protein, 479 aa, Homo sapiens
MVSKDTGKCILTTSESEVEPAACLALEMKYALDPNRQIKKRNKALQVRFKDICEAQNEQRDTQLSSGQLGEKREAKPVSCRAAYRKYMTVPARRSIPNVTKSTGVQTSPDLKKCYQTFPLDRKKGNLKSLPAADPFKSQNNGFLTDAKEKNEAGPMEEARPCGAGRVHKTTALVFHSNQHMNTVDQPLGVNCTEPCKSPEPLSYGEAALQNSTRPPSEEPDYQLLGRAKQDRGRPNSEEPAPPALRRVFKTEVATVYAPALSARAPEPGLSDSAAASQWSLCPADDERRRATHLNGLQAPSETALACSPPMQCLSPECSEQPSQTHTPPGLGNQPSPTAVAAGEECQRIVPHTEVVDLKAQLQMMENLISSSQETIKVLLGVIQELEKGEAHREGLSYRTGQDTANCDTCRNSACIIYSVELDFKQQEDKLQPVLRKLHPIEETQVIPSPYSQETYSSTPKQKSKTESKKHGRWKLWFL

SEQ ID NO: 12308 - protein, 535 aa, Homo sapiens
MAQQNMKVRPVLLKRNSLESVEFVKQPHHRRSKSQQVRFKEDGTTKNPTGLAEVDVQTPEDPAVMGKTQATRHHLPPTYSLSFPRSQKAGGFRNIAIQTSPSLRKHFPVFKRKRLTASKSLVEMPTASQSAIQVNGNLSEQDIVSSDLAYLRLAQHLEDGPRRVKVSHAFLPRVPKVQSNGPVSICLEAGTWRSLEKATAAIQVPDDIYHSPSWEARESALSPDRSAEVSNSIHPLDDTRPGDGRRVTPLDSEKSTSCLNATSVASHTPGTEELKPELLLPKDNSDDKDLGSLSSQSKETCVPSSPRTHSSPSQGSHSQPAHPGRASDCPSSSNNHQNLVSLKTNSASKSAPGCQEQTANNPTESDTLEFPNCPGSNHLPSSLSRSETKLQSNREISDINQIHLARGELCDLQGRLQSVEESLHSNQEKIKVLLNVIQDLEKARALTEGRNFYRTGQDLNNCSTCQNTACIIYSVEYDFRQQEGRFHEVLQSLEEAEPVEEASPPPKSPAEPPAPEKQDLRRKTKKVKKKCFWWI

SEQ ID NO: 12309 - protein, 388 aa, Homo sapiens
MSDEASAITSYEKFLTPEEPFPLLGPPRGVGTCPSEEPGCLDISDFGCQLSSCHRTDPLHRFHTNRWNLTSCGTSVASSEGSEELFSSVSVGDQDDCYSLLDDQDFTSFDLFPEGSVCSDVSSSISTYWDWSDSEFEWQLPGSDIASGSDVLSDVIPSIPSSPCLLPKKKNKHRNLDELPWSAMTNDEQVEYIEYLSRKVSTEMGLREQLDIIKIIDPSAQISPTDSEFIIELNCLTDEKLKQVRNYIKEHSPRQRPAREAWKRSNFSCASTSGVSGASASASSSSASMVSSASSSGSSVGNSASNSSANMSRAHSDSNLSASAAERIRDSKKRSKQRKLQQKAFRKRQLKEQRQARKERLSGLFLNEEVLSLKVTEEDHEADVDVLM

SEQ ID NO: 12310 - protein, 657 aa, Homo sapiens
MDHFFIKRKRNSEVKYTEACSSSSVESGIVNSDNIEKNTDSNLQTSTSFEPHFKKKKVSARRYNEDYLKYGFIKCEKPFENDRPQCVICNNILANESLKPSKLKRHLETQHAELIDKPLEYFQRKKKDIKLSTQFLSCSTAVSEKALLSSYLVAYRVAKEKIANTAAEKIILPACLDMVRTIFDDKSADKLKTIPNDNTVSLRICTIAEHLETMLITRLQSGIDFAIQLDESTDIGSCTTLLVYVRYAWQDDFLEDFLCFLNLTSHLSGLDIFTELERRIVGQYKLNWKNCKGITSDGTATMTGKHSRVIKKLLEVTNNGAVWNHCFIHREGLASREIPQNLMEVLKNAVKVVNFIKGSSLNSRLLETFCSEIGTNHTHLLYHTKIRWLSQGKILSRVYELRNEIHFFLIEKKSHLASIFEDDTWVTKLAYLTDIFSILNELSLKLQGKNSDVFQHVERIQGFRKTLLLWQVRLKSNRPSYYMFPRFLQHIEENIINENILKEIKLEILLHLTSLSQTFNHFFPEEKFETLRENSWVKDPFAFRHPESIIELNLVPEEENELLQLSSSYTLKNDYETLSLSAFWMKVKEDFPLLSRKSVLLLLPFTTTSLCELGFSILTQLKTKERNGLNCAAVMRVALSSCVPDWNELMNRQAHPS

SEQ ID NO: 12311 - protein, 155 aa, Homo sapiens
MGLRAGSRCRADHLAQPQPQGHLAPVLRCGECWRARGLPGGCCLHTEGGCSLGAQAGWRTAGWEARGRRDLGLETTSAHSRSLLHLSSWRRPDVGEAAGAELLQRAPLQQPDPAQAAVEGGLLARLPRPQDQGCGQHRPHSPRLVDIALPGGGWT

SEQ ID NO: 12312 - protein, 390 aa, Homo sapiens
MGEAGAGAGASGGPEASPEAEVVKLLPFLAPGARADLQAAAVRHVLALTGCGPGRALLAGQAALLQALMELAPASAPARDAARALVNLAADPGLHETLLAADPGLPARLMGRALDPQWPWAEEAAAALANLSREPAPCAALMAALAAAEPADSGLERLVRALCTPGYNARAPLHYLAPLLSNLSQRPAARAFLLDPDRCVVQRLLPLTQYPDSSVRRGGVVGTLRNCCFEHRHHEWLLGPEVDILPFLLLPLAGPEDFSEEEMERLPVDLQYLPPDKQREPDADIRKMLVEAIMLLTATAPGRQQVRDQGAYLILRELHSWEPEPDVRTACEKLIQVLIGDEPERGMENLLEVQVPEDVEQQLQQLDCREQEQLERELAPEPWVERATPT

SEQ ID NO: 12313 - protein, 390 aa, Homo sapiens
MGEAGAGAGASGGPEASPEAEVVKLLPFLAPGARADLQAAAVRHVLALTGCGPGRALLAGQAALLQALMELAPASAPARDAARALVNLAADPGLHETLLAADPGLPARLMGRALDPQWPWAEEAAAALANLSREPAPCAALMAALAAAEPADSGLERLVRALCTPGYNARAPLHYLAPLLSNLSQRPAARAFLLDPDRCVVQRLLPLTQYPDSSVRRGGVVGTLRNCCFEHRHHEWLLGPEVDILPFLLLPLAGPEDFSEEEMQRLPVDLQYLPPDKQREPDADIRKMLVEAIMLLTATAPGRQQVRDQGAYLILRELHSWEPEPDVRTACEKLIQVLIGDEPERGMENLLEVQVPEDVEQQLQQLDCREQEQLERELAPEPWVERATPT

SEQ ID NO: 12314 - protein, 151 aa, Homo sapiens
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEK

SEQ ID NO: 12315 - protein, 233 aa, Homo sapiens
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEKSGLEKRIDQAVEEWNIEKAEELSNQLATRELGVKIAKAVACHNFVKAKKEVENSQAARKKKKLAWGFEAKKRWETKSNMGYM

SEQ ID NO: 12316 - protein, 233 aa, Homo sapiens; identical to SEQ ID NO: 12315

SEQ ID NO: 12317 - protein, 138 aa, Homo sapiens
MLSPTFVLWDVGYPLYTYGSIFIVIVIIWQVKRSHHELNLEVERSCCWRHQKVRQRARDAASTARRLSQEEDQKPQELFSVMKRAGFPQREVCGESYVQIPVAKFAMLWLWRFSSCWRMRMTRSPQLCRGVHHRSPLA

SEQ ID NO: 12318 - protein, 230 aa, Homo sapiens
MGKVRGLRARVHQAAVRPKGEAAPGPAPPAPEATPPPASAAGKDWAFINTNIFARTKIDPSALVQKLELDVRSVTSVRRGEAGSSARSVPSIRRGAEAKTVLPKKEKMKLRREQWLQKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGQL

SEQ ID NO: 12319 - protein, 215 aa, Homo sapiens
MGKVRGLRARVHQAAVRPKGEAAPGPAPPAPEATPPPASAAGKDWAFINTNIFARTKIDPSALVQKLELDVRSVTSVRRGAEAKTVLPKKEKMKLRREQWLQKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGQL

SEQ ID NO: 12320 - protein, 1512 aa, Homo sapiens
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRSNSFNTDRNIDKYNYTLWKGQLLNKGKLLCYISLRSATRAFLPIKLPEKLDVETVMSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITGGNARSPEDQLGKHGEKQTPGMKSPEEQLVCVPPQEAFPNDPRVINRQRSSDYQFPSSPFTDTLKGTTEDDVLTGQVEEQCVPAAEAEPPAVSETTERTVLGEYNLFSRKIEEILKQKNVSYVSTVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSDAVLTLTPLELGVGISQH

SEQ ID NO: 12321 - protein, 1609 aa, Homo sapiens
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRSNSFNTDRNIDKYNYTLWKGQLLNKGKLLCYISLRSATRAFLPIKLPEKLDVETVMSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITDTLKGTTEDDVLTGQVEEQCVPAAEAEPPAVSETTERTVLGEYNLFSRKIEEILKQKNVSYVSTVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 12322 - protein, 1233 aa, Homo sapiens
MSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITGGNARSPEDQLGKHGEKQTPDTLKGTTEDDVLTGQVEEQCVPAAEAEPPAVSETTERTVLGEYNLFSRKIEEILKQKNVSYVSTVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 12323 - protein, 2430 aa, Homo sapiens
MAPPAHKSILERSENVLMSPWKGKLIVQDRMLCDIALWSTYGAMIPTQLPQELDFKYVMKVSSLKKRLPEAAFRKQNYLEEKVCFQDLCFNLYEVELSNRQGENIDKLTECIKNKQLAIIKCLEDRGFFILLTSSALLSEPDFGGKQMGLHGLHLFRSPLSTGVKDLKVEDDISMKVIPILSTLNCALLETKKSLPEERIHPNTLVKRHFQELYKADRSPSLSVAPQDRMKDPTFLGKLPSGFDLIPPAEKCPSESLTQLNSYFSDPSAYILEVSTALDLLAEHPQSPCVSDGICDAGFSLVMTPDPEFLVSEAEVRKETETKKDSEEMLKAKKRVFPLSPASNLRVQPKRKASMPHMVQSKKVNLCRPFPKRTASRADNSSDSPTTLKLVKGQFPQKRKRGAEVLTAQFVQKTKLDRKNQEAPISKDVPVPTNAKRARKQEKSPVKTVPRAKPPVKKSPQKQRVNIVKGNENPRNRKQLQPVKGETASKLQSEISRGCQEDGISINSVQPENTTAAHNDLPENSIVNYDSQALNMLADLALSSATSSTPVSEARNLHCSSELPQNDVLLSKENSLRGTSDHEYHRGVKTQKGELLPNPSSDRKSNSGSDLTVSQDEESLVPCSQAPAKAQSALTEEMLESSDASQSSSVSVEHSYALLLTEHSKKHLQEREILSPLFPRNGTKSPEAATPVGKVMPFRHQPGLLLQQKPPDDPVVKPKDRPPSARVKKSSCSRIVLSCDDSVKITFKCETEYAFSLDSKYTNNPLEKTVVRALHGPWNTDLPDNVEEVKLLLHMWVALFYSNQNKIIRSSRKVVEHSNPAKYVSINSTLESCELREIEESLGLEKCSADSLLETNEISRAHAAEVSFRDPNCLLPFIKTPLTQGLELCVQNEQKKTFARECDPDTQEDQNFICSYNNEVTGEEAKQESLETSNLVLSGIGSTQTNGPSVPSEEEIVQPLDSTRVASYSGTVTQATFTRTYDGPGSQPVICQSSVYGTLENKVDILDAAVQTKTGTLQDLIQHGSPINNECHPSLERKDDNMGCAVINPEPITLTFEKNAHVPIQTEGVNTADERTTFKKELIKQVSPAASLRHPVSTSENARTQGLRDIPSLVVAGQKGTKYLCASSVGGETLDKAVCSLQKETPLPVSLPSDKTMVMEALSLAKSSSHLSPSEEVRCTQDFLSQTQSLLGLSSEGLLELTQVEVDSSSASTTLGRQCSLNCISSGCHTSGDSLELRKNHKNGPNTENMNLEAFDSVFIKQTSLSVSREVSLELSEEDSDIDLALTISPPTSPREEMPAGEIEQFEEAPFSNLELQDVAEEIGEPEEVALTESREVSSADNVSVYPSVSEEPVENKERKGDNLQPVTLILSKENCTLEIAEEINVTSDFPFDSVIEEVSPASSPEPPVPVKETRPYQAVTPCILKLHGTQCEKSNQISQCESEDLGITEKENVFVGPTHPVGQDNFTQVQQMQVSAEMPLILTDHPGRTGRPTLPGKVTEEIVSSEHDEGLSFSGKVQCYGRELNQPASAAKCTGDFSPSPEKLVKSGNPLQPVSIENRNLDLKHLVLESSEPPFGPRNVIENKSLSDTLVSTTAPSGIVNVSVKQQTSPKSSQNHLFPGDLKTDEGIYLQVKSLTAASVDGAYSTQGCMCSVVPTLCSSSDNATLTHYVRPINAEPVFQAQEIPAGRMASLLKNGEPEAELHKETTGPGTAGPQSNTTSSLKGERKAIHTLQDVSTCETKELLNVGVSSLCAGPYQNTADTKENLSKEPLASFVSESFDTSVCGIATEHVEIENSGEGLRAEAGSETLGRDGEVGVNSDMHYELSGDSDLDLLGDCRNPRLDLEDSYTLRGSYTRKKDVPTDGYESSLNFHNNNQEDWGCSSWVPGMETSLPPGHWTAAVKKEEKCVPPYVQIRDLHGILRTYANFSITKELKDTMRTSHGLRRHPSFSANCGLPSSWTSTWQVADDLTQNTLDLEYLRFAHKLKQTIKNGDSQHSASSANVFPKESPTQISIGAFPSTKISEAPFLHPAPRSRSPLLVTVVESDPRPQGQPRRGYTASSLDSSSSWRERCSHNRDLRNSQRNHTVSFHLNKLKYNSTVKESRNDISLILNEYAEFNKVMKNSNQFIFQDKELNDVSGEATAQEMYLPFPGRSASYEDIIIDVCTNLHVKLRSVVKEACKSTFLFYLVETEDKSFFVRTKNLLRKGGHTEIEPQHFCQAFHRENDTLIIIIRNEDISSHLHQIPSLLKLKHFPSVIFAGVDSPGDVLDHTYQELFRAGGFVISDDKILEAVTLVQLKEIIKILEKLNGNGRWKWLLHYRENKKLKEDERVDSTAHKKNIMLKSFQSANIIELLHYHQCDSRSSTKAEILKCLLNLQIQHIDARFAVLLTDKPTIPREVFENSGILVTDVNNFIENIEKIAAPFRSSYW

SEQ ID NO: 12324 - protein, 1625 aa, Homo sapiens
MAPPAHKSILERSENVLMSPWKGKLIVQDRMLCDIALWSTYGAMIPTQLPQELDFKYVMKVSSLKKRLPEAAFRKQNYLEEKVCFQDLCFNLYEVELSNRQGENIDKLTECIKNKQLAIIKCLEDRGFFILLTSSALLSEPDFGGKQMGLHGLHLFRSPLSTGVKDLKVEDDISMKVIPILSTLNCALLETKKSLPEERIHPNTLVKRHFQELYKADRSPSLSVAPQDRMKDPTFLGKLPSGFDLIPPAEKCPSESLTQLNSYFSDPSAYILEVSTALDLLAEHPQSPCVSDGICDAGFSLVMTPDPEFLVSEAEVRKETETKKDSEEMLKAVCSLQKETPLPVSLPSDKTMVMEALSLAKSSSHLSPSEEVRCTQDFLSQTQSLLGLSSEGLLELTQVEVDSSSASTTLGRQCSLNCISSGCHTSGDSLELRKNHKNGPNTENMNLEAFDSVFIKQTSLSVSREVSLELSEEDSDIDLALTISPPTSPREEMPAGEIEQFEEAPFSNLELQDVAEEIGEPEEVALTESREVSSADNVSVYPSVSEEPVENKERKGDNLQPVTLILSKENCTLEIAEEINVTSDFPFDSVIEEVSPASSPEPPVPVKETRPYQAVTPCILKLHGTQCEKSNQISQCESEDLGITEKENVFVGPTHPVGQDNFTQVQQMQVSAEMPLILTDHPGRTGRPTLPGKVTEEIVSSEHDEGLSFSGKVQCYGRELNQPASAAKCTGDFSPSPEKLVKSGNPLQPVSIENRNLDLKHLVLESSEPPFGPRNVIENKSLSDTLVSTTAPSGIVNVSVKQQTSPKSSQNHLFPGDLKTDEGIYLQVKSLTAASVDGAYSTQGCMCSVVPTLCSSSDNATLTHYVRPINAEPVFQAQEIPAGRMASLLKNGEPEAELHKETTGPGTAGPQSNTTSSLKGERKAIHTLQDVSTCETKELLNVGVSSLCAGPYQNTADTKENLSKEPLASFVSESFDTSVCGIATEHVEIENSGEGLRAEAGSETLGRDGEVGVNSDMHYELSGDSDLDLLGDCRNPRLDLEDSYTLRGSYTRKKDVPTDGYESSLNFHNNNQEDWGCSSWVPGMETSLPPGHWTAAVKKEEKCVPPYVQIRDLHGILRTYANFSITKELKDTMRTSHGLRRHPSFSANCGLPSSWTSTWQVADDLTQNTLDLEYLRFAHKLKQTIKNGDSQHSASSANVFPKESPTQISIGAFPSTKISEAPFLHPAPRSRSPLLVTVVESDPRPQGQPRRGYTASSLDSSSSWRERCSHNRDLRNSQRNHTVSFHLNKLKYNSTVKESRNDISLILNEYAEFNKVMKNSNQFIFQDKELNDVSGEATAQEMYLPFPGRSASYEDIIIDVCTNLHVKLRSVVKEACKSTFLFYLVETEDKSFFVRTKNLLRKGGHTEIEPQHFCQAFHRENDTLIIIIRNEDISSHLHQIPSLLKLKHFPSVIFAGVDSPGDVLDHTYQELFRAGGFVISDDKILEAVTLVQLKEIIKILEKLNGNGRWKWLLHYRENKKLKEDERVDSTAHKKNIMLKSFQSANIIELLHYHQCDSRSSTKAEILKCLLNLQIQHIDARFAVLLTDKPTIPREVFENSGILVTDVNNFIENIEKIAAPFRSSYW

SEQ ID NO: 12325 - protein, 8 aa, Homo sapiens
MAPPAHKS

SEQ ID NO: 12326 - protein, 212 aa, Homo sapiens
MGTRQTKGSLAERASPGAAPGPRRERPDFWASLLLRAGDKAGRAGAGMPPYHRRVGMVQELLRMVRQGRREEAGTLLQHLRQDLGMESTSLDDVLYRYASFRNLVDPITHDLIISLARYIHCPKPPQGCPGRKPPRQHSGPVGNPTDLPRPGAGDQLPTALWGAGRQRGAGLHRPHGRHGPAAAASTQHPAPPHHTGTQWQPVDPGRAARPH

SEQ ID NO: 12327 - protein, 344 aa, Homo sapiens
MGTRQTKGSLAERASPGAAPGPRRERPDFWASLLLRAGDKAGRAGAGMPPYHRRVGMVQELLRMVRQGRREEAGTLLQHLRQDLGMESTSLDDVLYRYASFRNLVDPITHDLIISLARYIHCPKPEGDALGAMEKLCRQLTYHLSPHSQWRRHRGLVKRKPQACLKAVLAGSPPDNTVDLSGIPLTSRDLERVTSYLQRCGEQVDSVELGFTGLTDDMVLQLLPALSTLPRLTTLALNGNRLTRAVLRDLTDILKDPSKFPNVTWIDLGNNVDIFSLPQPFLLSLRKRSPKQGHLPTILELGEGPGSGEEVREGTVGQEDPGGGPVAPAEDHHEGKETVAAAQT

SEQ ID NO: 12328 - protein, 315 aa, Homo sapiens
MGARLGRRAGPEAGSEAGAAAGCGPAPYERRVRWLREIQSTLRERRPERARQLLRLLRQDLGLERTLLPDILYRDVAFLNPVDPISHDLLVNLARDLQCPKKDYELWKSSDKICRQLIYHLTPHSKQQQGSSLRQRKTQSCLKSSLQKTLLAGETVDLSGIPLSTQDVQHITRYLSSHGAVLAVLDLSFTGLSDELLHLLLPSLWALPRLTQLLLNGNRLTRATARKLTDAIKDTTKFPALAWVDLGNNVDVASLPQPLLVGLRRRLSQRTSLPTIYEGLDLEPEGSAAGATTPASTWDSTAAGLGPEPQACCAR

SEQ ID NO: 12329 - protein, 287 aa, Homo sapiens
MDMHSARLDSFLSQLRWELLCGRDTGSPSMPGPLQPTSQTGPDVQPSHQLRASGALEEDSVCCVEEEEEEEEEAVVTEDRDAALGGPREHALDWDSGFSEVSGSTWREEELPVSQRPAPSAQPLRRQCLSVSGLPMPSRAPVASVPPVHHPRPKSTPDACLEHWQGLEAEDWTAALLNRGRSRQPLVLGDNCFADLVHNWMELPETGSEGGDGGGHRARARPPQFLLGLSEQLRRRLARARRTAMAGKRLSCPPRPEPELPADVSRFAALMSCRSRQPIICNDVSYL

SEQ ID NO: 12330 - protein, 297 aa, Homo sapiens
MTMESREMDCYLRRLKQELMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDLPELEKGGEKGETGGAREPKGEKGQPQELGRRFALTANIFKKFLRSVRPDRDRLLKEKPGWVTPMVPESRTGRSQKVKKRSLSKGSGHFPFPGTGEHRRGENPPTSCPKALEHSPSGFDINTAVWV

SEQ ID NO: 12331 - protein, 282 aa, Homo sapiens
MRQLMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDLPELEKGGEKGETGGAREPKGEKGQPQELGRRFALTANIFKKFLRSVRPDRDRLLKEKPGWVTPMVPESRTGRSQKVKKRSLSKGSGHFPFPGTGEHRRGENPPTSCPKALEHSPSGFDINTAVWV

SEQ ID NO: 12332 - protein, 1076 aa, Homo sapiens
MKPDRDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLVPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQVTLFNPNKTVVKMFVVIYDLRDMPANHQTFLRQRTFSVPVKQEVKRSVNKENIRHTEERLLRYLIHLRFQSSKSGKIYLHRDVRLLFSRKSMEVDSGAAYELKSYTESPTNPQFSPRC

SEQ ID NO: 12333 - protein, 1076 aa, Homo sapiens
IRPRSDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLVPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQVTLFNPNKTVVKMFVVIYDLRDMPANHQTFLRQRTFSVPVKQEVKRSVNKENIRHTEERLLRYLIHLRFQSSKSGKIYLHRDVRLLFSRKSMEVDSGAAYELKSYTESPTNPQFSPRC

SEQ ID NO: 12334 - protein, 958 aa, Homo sapiens
RPDADTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLVPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQV

SEQ ID NO: 12335 - protein, 1083 aa, Homo sapiens
MVFSGNKGLHREDTLDEYFEYDAEEFLVSLALLITEGRTPECSVKGRTESFHCPPAQSCYPVTTKHECSDKLAQCRQARRTRSEVTLLWKNNLPIMVEMMLLPDCCYSDDGPTTEGIDLNDPAIKQDALLLERWILEPVPRQNGDRFIEEKTLLLAVRSFVFFSQLSAWLSVSHGAIPRNILYRISAADVDLQWNFSQTPIEHVFPVPNVSHNVALKVSVQSLPRQSNYPVLTCSIHTNIGLYEKRIQQHKLKTHQHHNPNEAEQCGTNSSQRLCSKQTWTMAPESVLHAKSGPSPEYTAAVKNIKLYPGTGSKSDHGTSQANILGFSGIGDIKSQETSVRTLKSFSMVDSSISNRQSFWQSAGETNPLIGSLIQERQEIIARIAQHLIHCDPSTSHVSGRPFNTQESSSLHSKLFRVSQENENVGKGKEAFSMTFGSPEFSSPEDTNEGKIRLKPETPRSETCISNDFYSHMPVGETNPLIGSLLQERQDVIARIAQHLEHIDPTASHIPRQSFNMHDSSSVASKVFRSSYEDKNLLKKNKDESSVSISHTKCSLLGDISDGKNLVPNKCFTSFKNNSKEKCSLKHQTRNQCQNNPSEIIQSTYQETQNKSSSLSTSSILSQHKENNLDLTSRFKEQEMSNGIDKQYSNCTTIDKQICTNKYKEKIINENYNPKFFGNLQSDDSKKNDSKIKVTVLEMSEYLNKYESMSSNKDSKRPKTCEQNTQLNSIENYLNKDNEGFKCKKSDQLKNEQDKQEDPTNEKSQNYSQRRSIKDCLSTCEQPKNTEVLRTTLKHSNVWRKHNFHSLDGTSTRAFHPQTGLPLLSSPVPQRKTQSGCFDLDSSLLHLKSFSSRSPRPCLNIEDDPDIHEKPFLSSSAPPITSLSLLGNFEESVLNYRFDPLGIVDGFTAEVGASGAFCPTHLTLPVEVSFYSVSDDNAPSPYMGVITLESLGKRGYRVPPSGTIQVTLFNPNKTVVKMFVVIYDLRDMPANHQTFLRQRTFSVPVKQEVKRSVNKENIRHTEERLLRYLIHLRFQSSKSGKIYLHRDVRLLFSRKSMEVDSGAAYELKSYTESPTNPQFSPRC

SEQ ID NO: 12336 - protein, 629 aa, Homo sapiens
MEVKGPSGRSFCCESEGQFKSCLKRHTPSLLLPSSWKGNSGSCLMAKALHRMSPTPNSCPLPLPLCRMSGVLCSRNLFTFKFSLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSTLPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQGAPSDAPGTDRC

SEQ ID NO: 12337 - protein, 878 aa, Homo sapiens
MEVKGPSGRSFCCESEGQFKSCLKRHTPSLLLPSSWKGNSGSCLMAKALHRMSPTPNSCPLPLPLCRMSGVLCSRNLFTFKFSLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSTLPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPVPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQFPSAERRGLNLAPSPANKAKKRPLFGSLSPAEKTPHPGPGLRVSGEQSLTWGLGGPSQSQKRKGDPLVSRKEKKQRCSQ

SEQ ID NO: 12338 - protein, 805 aa, Homo sapiens
MFQEPVYFQIFFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSTLPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPVPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQFPSAERRGLNLAPSPANKAKKRPLFGSLSPAEKTPHPGPGLRVSGEQSLTWGLGGPSQSQKRKGDPLVSRKEKKQRCSQ

SEQ ID NO: 12339 - protein, 262 aa, Homo sapiens
MEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPVPQQGVGMETCPPQTTARDSQGRGRAHTASGLLSPEKWGPQGTHQFPSAERRGLNLAPSPANKAKKRPLFGSLSPAEKTPHPGPGLRVSGEQSLTWGLGGPSQSQKRKGDPLVSRKEKKQRCSQ

SEQ ID NO: 12340 - protein, 656 aa, Homo sapiens
  MOD_RES (1)..(1): Any amino acid
XLTQAPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPVPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQFPSAERRGLNLAPSPANKAKKRPLFGSLSPAEKTPHPGPGLRVSGEQSLTWGLGGPSQSQKRKGDPLVSRKEKKQRCSQ

SEQ ID NO: 12341 - protein, 621 aa, Homo sapiens
MAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQLVEKRLPPLKEKQHARAAPSRGTARLDSSSSKFAAGQGAERDVPDPQQGVGMETCPPQMTARDSQGRGRAHTGMARSEDSVVLLGCQDSPGLRAAWPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKRPLFGSLSPAEKTPYPGPGLRVSGEQSLTWGLGGPSQSQKRKGDPLVSRKEKKQHCSQ

SEQ ID NO: 12342 - protein, 562 aa, Homo sapiens
MSGVLCSRNLFTFKFSLFQLDSGASGEPGHSLGLTLGFSYCGNCQTAVVSAQPEGMASNGAYPVLGPGVTANPGTSLSVFTALPFTTPAPGPAHGPLLVTAGAPPGGPLVLSTFPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQGAPSDAPGTDRC

SEQ ID NO: 12343 - protein, 878 aa, Homo sapiens
MEVKGPSGRSFCCESEGQFKSCLKRHTPSLLLPSSWKGNSGSCLMAEALHRTSPTPNSCPLPLPLCRMSGVLCSRNLFTFKFSLFQLDSGASGEPGHSLGLTLGFSYCGNCQTAVVSAQPEGMASNGAYPVLGPGVTANPGTSLSVFTALPFTTPAPGPAHGPLLVTAGAPPGGPLVLSTFPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQLVEKRLPPLKEKQHARAAPSRGTARLDSSSSKFAAGQGAERDVPDPQQGVGMETCPPQMTARDSQGRGRAHTGMARSEDSVVLLGCQDSPGLRAAWPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKRPLFGSLSPAEKTPYPGPGLRVSGEQSLTWGLGGPSQSQKRKGDPLVSRKEKKQHCSQ

SEQ ID NO: 12344 - protein, 629 aa, Homo sapiens
MEVKGPSGRSFCCESEGQFKSCLKRHTPSLLLPSSWKGNSGSCLMAEALHRTSPTPNSCPLPLPLCRMSGVLCSRNLFTFKFSLFQLDSGASGEPGHSLGLTLGFSYCGNCQTAVVSAQPEGMASNGAYPVLGPGVTANPGTSLSVFTALPFTTPAPGPAHGPLLVTAGAPPGGPLVLSTFPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQGAPSDAPGTDRC

SEQ ID NO: 12345 - protein, 877 aa, Homo sapiens
MEVKGPSGRSFCCESEGQFKSCLKRHTPSLLLPSSWKGNSGSCLMAEALHRMSPTPNSCPLPLPLCRMSGVLCSRNLFTFKFSFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSNFPSTPLVTEQDGCGPSGAGASNVFVQMRTEVGPVKAAQAQTLVLTQTPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPDPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKRPLFGSLSPAEKTPHPGPGLRVSGEQSLTWGLGGPSQSQKRKGDPLVSRKEKKQRCSQ

SEQ ID NO: 12346 - protein, 262 aa, Homo sapiens
MEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPDPQQGVGMETCPPQTTARDSQGRGRAHTASGLLSPEKWGPQGTHQSPSAERRGLNLAPSPANKAKKRPLFGSLSPAEKTPHPGPGLRVSGEQSLTWGLGGPSQSQKRKGDPLVSRKEKKQRCSQ

SEQ ID NO: 12347 - protein, 806 aa, Homo sapiens
MFQEPVYFQIFLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSNFPSTPLVTEQDGCGPSGAGASNVFVQMRTEVGPVKAAQAQTLVLTQTPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPDPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKRPLFGSLSPAEKTPHPGPGLRVSGEQSLTWGLGGPSQSQKRKGDPLVSRKEKKQRCSQ

SEQ ID NO: 12348 - protein, 557 aa, Homo sapiens
MFQEPVYFQIFLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSNFPSTPLVTEQDGCGPSGAGASNVFVQMRTEVGPVKAAQAQTLVLTQTPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQGAPSDAPGTDRC

SEQ ID NO: 12349 - protein, 252 aa, Homo sapiens
  MOD_RES (1)..(1): Any amino acid
XTGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPDPQQGVGMETCPPQTTARDSQGRGRAHTASGLLSPEKWGPQGTHQSPSAERRGLNLAPSPANKAKKRPLFGSLSPAEKTPHPGPGLRVSGEQSLTWGLGGPSQSQKRKGDPLVSRKEKKQRCSQ

SEQ ID NO: 12350 - protein, 878 aa, Homo sapiens
MEVKGPSGRSFCCESEGQFKSCLKRHTPSLLLPSSWKGNSGSCLMAEALHRTSPTPNSCPLPLPLCRMSGVLCSRNLFTFKFSLFQLDSGASGEPGHSLGLTLGFSYCGNCQTAVVSAQPEGMASNGAYPVLGPGVTANPGTSLSVFTALPFTTPAPGPAHGPLLVTAGAPPGGPLVLSTFPSTPLVTEQDGCSPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAQTACLPPPRPQRPVTKARRPPPQPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQLVEKRLPPLKEKQHSRAAPSRGTARLDSSSSKFAAGQGAERDVPDPQEGVGMETCPPQTTARDSQGRGRAHTGMARSEDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKQPLFGSLSPAEKTPHRGPGLRVSGEQSLTWGLGGPSQSQKRKGDPLVSRKEKKQHCSQ

SEQ ID NO: 12351 - protein, 756 aa, Homo sapiens
MASNGAYPVLGPGVTVNPGTSLSVFTALPFATPAPGPAHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNARPWPQGAHGEGSLAPSQAKARPDDSCKPKSVYENFRLWQHYKPLARRHLPQSPDTEALSCFLIPVLRSLARRKPTMTLEEGLWQAMREWQHTSNFDRMIFYEMAEKFLEFEAEEEMQIQKSQWMKGPQSLPPPAPPRLEPRGPPAPEVVKQPVYLPSKDGPKAPTACLPPPRPQRPAETKAHLPPPRPQRPAETNAHLPPPRPQRPAETKVPEEIPPEVVQEYVDIMEELLGSHPGDTGEPEGQREKGKVEQPQEEDGITSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 12352 - protein, 492 aa, Homo sapiens
MASNGAYPVLGPGVTVNPGTSLSVFTALPFATPAPGPAHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNARPWPQGAHGEGSLAPSQAKARPDDSCKPKSVYENFRLWQHYKPLARRHLPQSPDTEALSCFLIPVLRSLARRKPTMTLEEGLWQAMREWQHTSNFDRMIFYEMAEKFLEFEAEEEMQIQKSQWMKGPQSLPPPAPPRLEPRGPPAPEVVKQPVYLPSKDGPKAPTACLPPPRPQRPAETKAHLPPPRPQRPAETKVPEEIPPEVVQEYVDIMEELLGSHPGDTGEPEGQREKGKVEQPQEEDGITSDPGLLSYIDKLCSQEDFVTKVEAVIHPRFLEELLSPDPQMDFLALSQELEQEEGLTLAQGAPSDALGTDRC

SEQ ID NO: 12353 - protein, 741 aa, Homo sapiens
MASNGAYPVLGPGVTVNPGTSLSVFTALPFATPAPGPAHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNARPWPQGAHGEGSLAPSQAKARPDDSCKPKSVYENFRLWQHYKPLARRHLPQSPDTEALSCFLIPVLRSLARRKPTMTLEEGLWQAMREWQHTSNFDRMIFYEMAEKFLEFEAEEEMQIQKSQWMKGPQSLPPPAPPRLEPRGPPAPEVVKQPVYLPSKDGPKAPTACLPPPRPQRPAETKAHLPPPRPQRPAETKVPEEIPPEVVQEYVDIMEELLGSHPGDTGEPEGQREKGKVEQPQEEDGITSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 12354 - protein, 590 aa, Homo sapiens
MASNGAYPVLGPGVTVNPGTSLSVFTALPFATPAPGPAHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNARPWPQGAHGEGSLAPSQAKARPDDSCKPKSVYENFRLWQHYKPLARRHLPQKVVQEYVDIMEELLGSHPGDTGEPEGQREKGKVEQPQEEDGITSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 12355 - protein, 492 aa, Homo sapiens
MASNGAYPVLGPGVTVNPGTSLSVFTALPFATPSPGPTHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNAGPWPQGAHGEGSLAPSQAKARPDDSCKPKSVYENFRLWQHYKPLARRHLPQSPDTEALSCFLIPVLRSLARRKPTMTLEEGLWRAMREWQHTSNFDRMIFYEMAAKFLEFEAEEEMQIQKSQWMKGPQSLPPPAPPRLEPRGPPAPEVVKQPVYLPSKDGPKAPTACLPPPRPQRPAETKAHLPPPRPPRPAETKVPEEIPPEVVQEYVDIMEELLGSHPGDTGEPEGQREKGKVEQPQEEDGMTSDPGLLSYIDKLCSQEDFVTKVEAVIHPRFLEELLSPDPQMDFLALSQELEQEEGLTLAQGAPSDALGTDRC

SEQ ID NO: 12356 - protein, 741 aa, Homo sapiens
MASNGAYPVLGPGVTVNPGTSLSVFTALPFATPSPGPTHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNAGPWPQGAHGEGSLAPSQAKARPDDSCKPKSVYENFRLWQHYKPLARRHLPQSPDTEALSCFLIPVLRSLARRKPTMTLEEGLWRAMREWQHTSNFDRMIFYEMAAKFLEFEAEEEMQIQKSQWMKGPQSLPPPAPPRLEPRGPPAPEVVKQPVYLPSKDGPKAPTACLPPPRPQRPAETKAHLPPPRPPRPAETKVPEEIPPEVVQEYVDIMEELLGSHPGDTGEPEGQREKGKVEQPQEEDGMTSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 12357 - protein, 622 aa, Homo sapiens
MCPPPLLLAAAPGVPVTSAQVVGGTQACEGGWSHGLPLPPPPPAAQVAPIVSPGNAGPWPQGAHGEGSLAPSQAKARPDDSCKPKSVYENFRLWQHYKPLARRHLPQSPDTEALSCFLIPVLRSLARRKPTMTLEEGLWRAMREWQHTSNFDRMIFYEMAAKFLEFEAEEEMQIQKSQWMKGPQSLPPPAPPRLEPRGPPAPEVVKQPVYLPSKDGPKAPTACLPPPRPQRPAETKAHLPPPRPPRPAETKVPEEIPPEVVQEYVDIMEELLGSHPGDTGEPEGQREKGKVEQPQEEDGMTSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 12358 - protein, 590 aa, Homo sapiens
MASNGAYPVLGPGVTVNPGTSLSVFTALPFATPSPGPTHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNAGPWPQGAHGEGSLAPSQAKARPDDSCKPKSVYENFRLWQHYKPLARRHLPQKVVQEYVDIMEELLGSHPGDTGEPEGQREKGKVEQPQEEDGMTSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 12359 - protein, 562 aa, Homo sapiens; identical to SEQ ID NO: 10215

SEQ ID NO: 12360 - protein, 319 aa, Homo sapiens
MKNVDSDDLVTGTLPKLKSSKEWLEPKPLCFMEVLAKEDTEAAIQSILYKENSVIKELDKYLQHHAFLNARRKEMLYKRWVDCVADPLQKKIIEKVCSHKKIKKRRQGELDGFLKHVNKKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSRNGRKTRMGLPPRVWGC

SEQ ID NO: 12361 - protein, 105 aa, Homo sapiens
MAKMFDLRTKIMIGIGSSLLVAAMVLLSVVFCLYFKVAKALKAAKDPDAVAVKNHNPDKVCWATNSQAKATTMESCPSLQCCEGCRMHASSDSLPPCCCDINEGL

SEQ ID NO: 12362 - protein, 96 aa, Homo sapiens
  MOD_RES (1)..(1): Any amino acid
XTVCCHTMLGGLGKLAAEGLAHRTEKATEGAIHAVEEVVKEVVGHAKETGEKAIAEAIKKAQESGDKKMKEITETVTNTVTNAITHAAESLDKLGQ

SEQ ID NO: 12363 - protein, 89 aa, Homo sapiens; identical to SEQ ID NO: 9090

SEQ ID NO: 12364 - protein, 96 aa, Homo sapiens; identical to SEQ ID NO: 12362
  MOD_RES (1)..(1): Any amino acid

SEQ ID NO: 12365 - protein, 96 aa, Homo sapiens; identical to SEQ ID NO: 12362
  MOD_RES (1)..(1): Any amino acid

SEQ ID NO: 12366 - protein, 89 aa, Homo sapiens; identical to SEQ ID NO: 9090

SEQ ID NO: 12367 - protein, 89 aa, Homo sapiens; identical to SEQ ID NO: 9090

SEQ ID NO: 12368 - protein, 96 aa, Homo sapiens; identical to SEQ ID NO: 12362
  MOD_RES (1)..(1): Any amino acid

SEQ ID NO: 12369 - protein, 67 aa, Homo sapiens
MRKPQAGTGEAARDPSLRPARTVLVGDQDEYTAAENKSPRGTLCPTGEQRIHAREDACIFSRLFSEK

SEQ ID NO: 12370 - protein, 67 aa, Homo sapiens; identical to SEQ ID NO: 12369

SEQ ID NO: 12371 - protein, 125 aa, Homo sapiens
MGIFQLLRDRRISSRGPGLHTPKAEPRRRKGLTTGLMTQAERQKQAHQRQATMRETALWCTGHIRPRTHMHTGTHTQTDRERERNTQRLRDRERRENGRHTHIHTQTHRQSLIAKALKDTHPGNP

SEQ ID NO: 12372 - protein, 92 aa, Homo sapiens
MTKPQAESGEAARHPIFRPARRVFGIKMTTLQPRIKAPQELTVLQERSRPTSKKMAVCFHGSSLRSEATPRYSLEEEARNGRWQQALSWWPL

SEQ ID NO: 12373 - protein, 835 aa, Homo sapiens
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 12374 - protein, 904 aa, Homo sapiens
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGYIWEFKYLFVQCNYTLENLELHTTPWSSCECLFDDDIRAITFKAKFQKSAPSFVKISDLATHLEDKCSGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 12375 - protein, 559 aa, Homo sapiens
  MOD_RES (1)..(1): Any amino acid
XDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGYIWEFKYLFVQCNYTLENLELHTTPWSSCECLFDDDIRAITFKAKFQKSAPSFVKISDLATHLEDKCSGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 12376 - protein, 835 aa, Homo sapiens; identical to SEQ ID NO: 12373

SEQ ID NO: 12377 - protein, 243 aa, Homo sapiens
MLTVEQAQDQHYALVLWGPGAAWYPQLQRKKGYIWEFKYLFVQRNYTLENLELHTTPWSSCECLFDDDIRAITFKAKFQKSAPSFVKISDLATHLEDKCSGVVLIKAQISELAFPLTAAQKIALNAHSSLKSIFSSLPNIIYTGCAKCGLELETDENRIYKQCFSCLPFTMKKIYYRPALMTAVDGRHNVYIRVESKLIEKILLNISAHCLNRVIGNISRSPMGWLWQTCSTPCWQSAQNLVY

SEQ ID NO: 12378 - protein, 212 aa, Homo sapiens
MLTVEQAQDQHYALVLWGPGAAWYPQLQRKKGVVLIKAQISELAFPLTAAQKIALNAHSSLKSIFSSLPNIIYTGCAKCGLELETDENRIYKQCFSCLPFTMKKIYYRPALMTAVDGRHNVYIRVESKLIEKILLNISAHCLNRVIVPSSEITYGMVVADLFHSLLAVSAEPCVLKIQSLFVLDENSYPLQQDFSLLDFYPDMVKHGANARL

SEQ ID NO: 12379 - protein, 834 aa, Homo sapiens
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNDIDARPWDFQAEECTLRANIEAFNSRRYDRPQDSEFSPVDNCLQSVLGQRLDLPEDFHYSYELWLEREVFSQPICWEELLQNH

SEQ ID NO: 12380 - protein, 758 aa, Homo sapiens
MEDPAAPGTGGPPANGNGNGGGKGKQAAPKGREAFRSQRRESEGSVDCPTLEFEYGDADGHAAELSELYSYTENLEFTNNRRCFEEDFKTQVQGKEWLELEEDAQKAYIMGLLDRLEVVSRERRLKVARAVLYLAQGTFGECDSEVDVLHWSRYNCFLLYQMGTFSTFLELLHMEIDNSQACSSALRKPAVSIADSTELRVLLSVMYLMVENIRLERETDPCGWRTARETFRTELSFSMHNEEPFALLLFSMVTKFCSGLAPHFPIKKVLLLLWKVVMFTLGGFEHLQTLKVQKRAELGLPPLAEDSIQVVKSMRAASPPSYTLDLGESQLAPPPSKLRGRRGSRRQLLTKQDSLDIYNERDLFKTEEPATEEEEESAGDGERTLDGELDLLEQDPLVPPPPSQAPLSAERVAFPKGLPWAPKVRQKDIEHFLEMSRNKFIGFTLGQDTDTLVGLPRPIHESVKTLKQHKYISIADVQIKNEEELEKCPMSLGEEVVPETPCEILYQGMLYSLPQYMIALLKILLAAAPTSKAKTDSINILADVLPEEMPITVLQSMKLGIDVNRHKEIIVKSISTLLLLLLKHFKLNHIYQFEYVSQHLVFANCIPLILKFFNQNILSYITAKNSISVLDYPCCTIQDLPELTTESLEAGDNSQFCWRNLFSCINLLRLLNKLTKWKHSRTMMLVVFKSAPILKRALKVKQAMLQLYVLKLLKLQTKYLGRQWRKSNMKTMSAIYQKVRHRMNDDWAYGNGESSQSS

SEQ ID NO: 12381 - protein, 211 aa, Homo sapiens
MFSQGLCSDSMFPEMWRPVDMGWPQTRMPRVRSLHAYPPFFPLQQLLTKQDSLDIYNERDLFKTEEPATEEEEESAGDGERTLDGELDLPWAPKVRQKDIEHFLEMSRNKFIGFTLGQDTDTLVGLPRPIHESVKTLKQHKYISIADVQIKNEEELEKCPMSLVSQGSPTQEESRRKPVFSVVTEHVCMHSFSILGCNCVPGGRGGTRDAM

SEQ ID NO: 12382 - protein, 423 aa, Homo sapiens
MLPWKKHKFELLAEAPPRQASKPKGYAVSLHYSALSSLARACPEGALSRVGSMFRSKRKKLHITSEDPTYTVLYLGNATTIQARGDGCTDLAVGKIWSKSEAGRQGTKMKLTVSAQGIRMVHAEERALRRPGHLYLLHRVTYCVADARLPKVFAWVYRHELKHKAVMLRCHAVLVSKPEKAQAMALLLYQTSANALAEFKRLKRRDDARHQQQELVGAHTIPLVPLRKLLLHGPCCYKPPVERSRSAPKLGSITEDLLGEQLEQELQEEEEEEQPEGCPEEEENRAAEGDPAEEEAEAQRALVVAMHFECGDLLDTLENGRGEALGGGGGSLGPGAGPPPLLLGSASDMKAELSQLISDLGELSFGNDVRTLQADLRVTRLLSGDSTGSESSIEGGGPDATSATAGDSSRQADGASADEPHSG

SEQ ID NO: 12383 - protein, 329 aa, Homo sapiens
MLPWRRNKFVLVEDEAKCKAKSLSPGLAYTSLLSSFLRSCPDLLPDWPLERLGRVFRSRRQKVELNKEDPTYTVWYLGNAVTLHAKGDGCTDDAVGKIWARCGPGGGTKMKLTLGPHGIRMQPCERSAAGGSGGRRPAHAYLLPRITYCTADGRHPRVFAWVYRHQARHKAVVLRCHAVLLARAHKARALARLLRQTALAAFSDFKRLQRQSDARHVRQQHLRAGGAAASVPRAPLRRLLNAKCAYRPPPSERSRGAPRLSSIQEEDEEEEEDDAEEQEGGVPQRERPEVLSLARELRTCSLRGAPAPPPPAQPRRWKAGPRERAGQAR

SEQ ID NO: 12384 - protein, 357 aa, Homo sapiens
MAAAEVADTQLMLGVGLIEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKDIVSQFGMETVILHTALMLKKRIVVYHPKIEAVQEFTRTLPALVWHRQDWTILHSYVHLNADELEALQMCTGYVAGFVDLEVSNRPDLYDVFVNLAESEITIAPLAKEAMAMGKLHKEMGQLIVQSAEDPEKSESHVIQDIALKTREIFTNLAPFSEVSADGEKRVLNLEALKQKRFPPATENFLYHLAAAEQMLKI

SEQ ID NO: 12385 - protein, 200 aa, Homo sapiens
MAAAEVADTQLMLGVGLIEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKGLCLPWCGTDRTGPSFTLTCTSTPMSWKPCRCAQVTSLDL

SEQ ID NO: 12386 - protein, 206 aa, Homo sapiens
MLPSLGYCVDIVSQFGMETVILHTALMLKKRIVVYHPKIEAVQEFTRTLPALVWHRQDWTILHSYVHLNADELEALQMCTGYVAGFVDLEVSNRPDLYDVFVNLAESEITIAPLAKEAMAMGKLHKEMGQLIVQSAEDPEKSESHVIQDIALKTREIFTNLAPFSEVSADGEKRVLNLEALKQKRFPPATENFLYHLAAAEQMLKI

SEQ ID NO: 12387 - protein, 221 aa, Homo sapiens
MAAAEVADTQLMLGVGLIEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKDIVSQFGMNCYLTHSTDAKEKNCGVSPQDRSGPGVHQDSACPGVAPTGLDHPSLLRAPQRR

SEQ ID NO: 12388 - protein, 461 aa, Homo sapiens
MHQRYFWTDQGQVALGGHYMAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 12389 - protein, 523 aa, Homo sapiens
MQMRRVWRTCRSGPRKRREARYKKSTEDIFPAQLLKLQRHERVWQQEPPVRDHRSWGGSGAGGVAGREWTDQGQVALGGHYMAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 12390 - protein, 88 aa, Homo sapiens
  MOD_RES (1)..(1): Any amino acid
XKRIGVRDVRLNGSAASHVLHQDSGLGYKDLDLIFCADLRGEGEFQTVKDVVLDCLLDFLPEGVNKEKITPLTLKEESHTTTYFLNIS

SEQ ID NO: 12391 - protein, 86 aa, Homo sapiens
  MOD_RES (1)..(1): Any amino acid
XQDSGLGYKDLDLIFCADLRGEGEFQTVKDVVLDCLLDFLPEGVNKEKITPLTLKVFHRLLRHWRAAEKTGVLFAEPLCGIGRPQV

SEQ ID NO: 12392 - protein, 425 aa, Homo sapiens
MMPSESGAERRDRAAAQVGTAAATAVATAAPAGGGPDPEALSAFPGRHLSGLSWPQVKRLDALLSEPIPIHGRGNFPTLSVQPRQIVQVVRSTLEEQGLHVHSVRLHGSAASHVLHPESGLGYKDLDLVFRVDLRSEASFQLTKAVVLACLLDFLPAGVSRAKITPLTLKEAYVQKLVKVCTDSDRWSLISLSNKSGKNVELKFVDSVRRQFEFSIDSFQIILDSLLLFGQCSSTPMSEAFHPTVTGESLYGDFTEALEHLRHRVIATRSPEEIRGGGLLKYCHLLVRGFRPRPSTDVRALQRYMCSRFFIDFPDLVEQRRTLERYLEAHFGGADAARRYACLVTLHRVVNESTVCLMNHERRQTLDLIAALALQALAEQGPAATAALAWRPPGTDGVVPATVNYYVTPVQPLLAHAYPTWLPCN

SEQ ID NO: 12393 - protein, 389 aa, Homo sapiens
MSEIRFTNLTWDQVITLDQVLDEVIPIHGKGNFPTMEVKPKDIIHVVKDQLIGQGIIVKDARLNGSVASYILASHNGISYKDLDVIFGVELPGNEEFQVVKDAVLDCLLDFLPKDVKKEKLSPDIMKDAYVQKLVKVCNGHDCWSLISLSNNTGKNLELKFVSSLRRQFEFSVDSFQIVLDPMLDFYSDKNAKLTKESYPVVVAESMYGDFQEAMTHLQHKLICTRKPEEIRGGGLLKYCSLLVHGFKPACMSEIKNLERYMCSRFFIDFPHIEEQQKKIESYLHNHFIGEGMTKYDYLMTLHGVVNESTVCLMSYERRQILHLITMMALKVLGELNILPNTQKVTCFYQPAPYFAAEARYPIYVIPEPPPVSFQPYHPLHFRGSNGMS

SEQ ID NO: 12394 - protein, 389 aa, Homo sapiens; identical to SEQ ID NO: 12393

SEQ ID NO: 12395 - protein, 295 aa, Homo sapiens
MQMSVPCVLSSLQNHEPNKPLFTTQSQLLSKVLEVLDPDRKLEDTWAYCQDTRKGMKEPTKLLKKHSTQVYLGPSKKTSVSNAGQWLYEEKPHKMDLLHENGPRPGLHENVCKAVSDFCKWVTTFGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQEELLADLHGTVAFKDFILSRGYRTPRFLENMYIGKECKRACNKTPIKRTQA

SEQ ID NO: 12396 - protein, 351 aa, Homo sapiens
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQSIFKKAMDI

SEQ ID NO: 12397 - protein, 791 aa, Homo sapiens
MGDQRLQDWLRSPGMDSKPWYCNKRPSKCFAKCKHRRLRFPPMDTQNWVFVKEGMDDFRYGCPSPEDTLVCRRDEFLLPKISLRGPQADPKSGQKKLLKKAALFSKLSPAQLARKAFVEQVEAQLMAKHPLAMYPNLGEDMPPDLLLQVLKHLDPERELEDAWACCETQEKTTEVPTEPGKHPCGEFCLKPPETPVSHLLPEPPETGVSHLSPEPPKTPVSSLRPEPPETGVSHLRPEPPETGVSHIRPGPPITRRRSSLLRQLLKLDSERKLEDARAPCEGREKTTDEPTEPGKYPCGKFCPRPFETPLSHLRQEPPKTPVSSLRPEPPETGESHLRLEHSKTRRGSSLRSEPSETGVSRLRLAPPKTRRGSSLHAEPSKTGVSHLSPEPPKTEVSHLHPVPPKTGVCHLRLEPPDTSQVSNLLLYILKVLDSGRTLKDVWDRCEARVKKTKEPTEPHKSPCGEPCLQPPETQVSHPHPEHPKTRRRSSLHSQPPKTRRTSSLRSEPPKTRRTSSLRSEPPKTRRTSSLGPEPPKTRRVSSLRPELPKSRRVSSLHPEPPKAPESHQFSEPPKIRASYIKELLQEDTPSTKECVSDSLQYRYTSEKLREFFKWAGDLGADEESIRNLFDFTPKYRATHEDQKFKKVKECSSELKYSMELDEKDEDKFFSQEKYWGRKFHTPSNSYTAQRVKMKYGAWYLKPKLWKKLRSDEPLIDPKLLLKKPDEPDVLDDLYGPIAFKDFILSKGYEMPGIIQRLFARRGWTYDSVKTPIQRAMIFYKYKEIVEASEED

SEQ ID NO: 12398 - protein, 645 aa, Homo sapiens
MGDRRPQDRPRSQGMDSKPWYCDKPPSKYFAKRKHRRLRFPPVDTQNWVFVTEGMDDFRYACQSPEDTLVCRRDEFLLPKISLRGPQADRKSRKKKLLKKAALFSELSPVQPARKAFVEEVEAQLMTKHPLAMYPNLGKDMPPDLLLQVLKQLDPERKLEDAWARCEAREKTTEVPTESGKYPCGESCPRPPETPVSRLRPQLPKTPVSSRRPEPPKTRVSSLRPEPPKTRVSSLHPEPPETRASHLRVDPPETGVSHLCPEPPKTLVSSVHPEPPDTGASHLCPEPPETRVSHLHPEPPETGVSHLRPEPSKTQVSSLCPEPPEAGVSHLCLEPPNTHRVSSFLLQVLKLDSEKKLEDARARCEGQEMTTEELTKPGKYHFWESCPRPFESRMPHLRLVLPITRRMASLCLKPPKTRRVSSLCPEPTKTGASHLKELFQEDTPSTMECVSDSLQRRHTSRKLRDFKWAGDLGVNEESISSLFDFTPECRTTDQDQKIKKANECASRLMYGMELDDMDEVEFLRIKYWDRRRRAAPHSYSAQRGRIRYGPWYFEPKLGKKLRSDEPLIDPKPVLEKPDEPDILDGLYGPIAFKDFILSKGYRMPGVIEKLFAKKGWTYDSVKTPIQRAVQVYKYKEDVTDASKED

SEQ ID NO: 12399 - protein, 1035 aa, Homo sapiens
MGDQRPQDRPSSPGMDSTPWYCDKPPSKYFAKRKHRRLRFPPVDTQNWVFVTEGMDDFRYGCQSPEDTLVCRRDEFLLPKISLRGPQADPKSRKKKLLKKAALFSKLSPAQPARKAFVEEVEAQLMTKHPLAMYPNLGEDMPPDLLLQVLKPLDPERKLEDAGSCEGQEKTTDEPTEPGKYPCGEFSPRPPETRVSCLPPEPPKTPVSSLRPEPPETGVSHLRPQPPKTQVSSLHLEPPETGVSHLRPEPPKTQVSSLHLEPPETGVSHLYLEPPGTGVSHLCPEPPKTRVSHLHREPPETGVPDLCLEPPKSRVSHLRPEPSETGVSHLHPEPPKTLVSSLHPEPPETGVSHLCPEPPETRVSPLRQLPPEAGVSHLCPEPPKTRVPPLRPETPKNGVSPLFPEPPKTRISNLRSEPPKIGVSHLCLEPPKTRGSHLRPEPPETGVSHLRPEPPKTRVSSLHLEPPETGVSHLCPEPPEKDVSHLRPEPPDTGVSHLCPEPPKTRVSHLRPEPSETGVSHLRPEPPKILVSSLHQAPPESSVSHLRPEPPETGVSHLRPEPPKTRMYSLRPEPPDTGVSHLCPEPPKTRVSSLPPEPPETGVSHLCPEPPETRVSHLRPEPPETGVSHLRPEPPKTRMYSLRPEPPNTGVSHLCPEPPKTRVSSLPPEPPETGVSHLCPEPPETRVSHLRPEPPETGVSRLHPEPPKTRVSSLHAEPPESRVSHLCPEPPETGVSHLRPEPPKPRVSSLRPEPLETRVSHLRPEPPETGVSHLHPELPKPRVSSLHLEPPKTRRVSSLRLEPPKTGRVSSLCPEPTKTGASHLKELFQEGTSSTMECVSDSLQRRHTSRKLRDFKWAGDLGVNEESISSLFDFTPECRATYQDQKNKKANECSSGLKYSMELDEMDEVKFFSQEKDLDGKIQNAPNSHSAQHVKMGYGAWYLKPKLGKKLRSDEPLIDPKLVLEKPDEPDILDGLYGPIAFKDFILSKGYEMPGIIQRLFARRGWTYDSVKTPIQRAMQVYKYKEDVTDASEED

SEQ ID NO: 12400 - protein, 295 aa, Homo sapiens; identical to SEQ ID NO: 12395

SEQ ID NO: 12401 - protein, 393 aa, Homo sapiens
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQEELLADLHGTVAFKDFILSRGYRTPRFLENMYIGKECKRACNKTPIKRTQA

SEQ ID NO: 12402 - protein, 323 aa, Homo sapiens
MGNLLKVLTREIENYPHFFLDFENAQPTEGEREIWNQISAVLQDSESILADLQAYKGAGPEIRDAIQNPNDIQLQEKAWNAVCPLVVRLKRFYEFSIRLEKALQSLLESLTCPPYTPTQHLEREQALAKEFAEILHFTLRFDELKMRNPAIQNDFSYYRRTISRNRINNMHLDIENEVNNEMANRMSLFYAEATPMLKTLSNATMHFVSENKTLPIENTTDCLSTMTSVCKVMLETPEYRSRFTSEETLMFCMRVMVGVIILYDHVHPVGAFCKTSKIDMKGCIKVLKEQAPDSVEGLLNALRFTTKHLNDESTSKQIRAMLQ

SEQ ID NO: 12403 - protein, 323 aa, Homo sapiens; identical to SEQ ID NO: 12402

SEQ ID NO: 12404 - protein, 323 aa, Homo sapiens; identical to SEQ ID NO: 12402

SEQ ID NO: 12405 - protein, 94 aa, Homo sapiens
MGNLLKVLTREIENYPHFFLDFENAQPTEGEREIWNQISAVLQDSESILADLQAYKGAGPEIRDAIQNPNDIQLQEKAWNAVCPLVVRLKRFYE

SEQ ID NO: 12406 - protein, 87 aa, Homo sapiens
MGNLLKVLTREIENYPHFFLDFENAQPTEGEREIWNQISAVLQDSESILADLQAYKGAGPEIRDAIQNPNDIQLQEKAWNAVCPLVV

SEQ ID NO: 12407 - protein, 217 aa, Homo sapiens [sequence omitted]

SEQ ID NO: 12408 - protein, 324 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 12409 - protein, 324 aa, Homo sapiens; identical to SEQ ID NO: 12408

SEQ ID NO: 12410 - protein, 63 aa, Homo sapiens
MGNLLKVLTCTDLEQGPNFFLDFENAQPTESEKEIYNQVNVVLKDAEGILEDLQSYRGAGHEI

SEQ ID NO: 12411 - protein, 65 aa, Homo sapiens
MGNLLKVLTCTDLEQGPNFFLDFENAQPTESEKEIYNQVNVVLKDAEGILEDLQSYRGAGHEIRE

SEQ ID NO: 12412 - protein, 98 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQ

SEQ ID NO: 12413 - protein, 68 aa, Homo sapiens
MGNLLKVLTCTDLEQGPNFFLDFENAQPTESEKEIYNQVNVVLKDAEGILEDLQSYRGAGHEIREAIQ

SEQ ID NO: 12414 - protein, 48 aa, Homo sapiens
MGNLLKVLTCTDLEQGPNFFLDFENAQPTESEKEIYNQVNVVLKDAEG

SEQ ID NO: 12415 - protein, 324 aa, Homo sapiens; identical to SEQ ID NO: 12408

SEQ ID NO: 12416 - protein, 155 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKVELSIGPDC

SEQ ID NO: 12417 - protein, 324 aa, Homo sapiens; identical to SEQ ID NO: 12408

SEQ ID NO: 12418 - protein, 324 aa, Homo sapiens; identical to SEQ ID NO: 12408

SEQ ID NO: 12419 - protein, 100 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRL

SEQ ID NO: 12420 - protein, 79 aa, Homo sapiens
MGNLLKVLTCTDLEQGPNFFLDFENAQPTESEKEIYNQVNVVLKDAEGILEDLQSYRGAGHEIREAIQHPADEKLQEKA

SEQ ID NO: 12421 - protein, 46 aa, Homo sapiens
MGNLLKVLTCTDLEQGPNFFLDFENAQPTESEKEIYNQVNVVLKDA

SEQ ID NO: 12422 - protein, 324 aa, Homo sapiens; identical to SEQ ID NO: 12408

SEQ ID NO: 12423 - protein, 324 aa, Homo sapiens; identical to SEQ ID NO: 12408

SEQ ID NO: 12424 - protein, 93 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKF

SEQ ID NO: 12425 - protein, 325 aa, Homo sapiens
MAQYKGTMREAGRAMHLLKKRERQREQMEVLKQRIAEETILKSQVDKRFSAHYDAVEAELKSSTVGLVTLNDMKARQEALVRERERQLAKRQHLEEQRLQQERQREQEQRRERKRKISCLSFALDDLDDQADAAEARRAGNLGKNPDVDTSFLPDRDREEEENRLREELRQEWEAQREKVKDEEMEVTFSYWDGSGHRRTVRVRKGNTVQQFLKKALQGLRKDFLELRSAGVEQLMFIKEDLILPHYHTFYDFIIARARGKSGPLFSFDVHDDVRLLSDATMEKDESHAGKVVLRSWYEKNKHIFPASRWEAYDPEKKWDKYTIR

SEQ ID NO: 12426 - protein, 325 aa, Homo sapiens; identical to SEQ ID NO: 12425

SEQ ID NO: 12427 - protein, 422 aa, Homo sapiens
MVMVLSESLSTRGADSIACGTFSRELHTPKKMSQGPTLFSCGIMENDRWRDLDRKCPLQIDQPSTSIWECLPEKDSSLWHREAVTACAVTSLIKDLSISDHNGNPSAPPSKRQCRSLSFSDEMSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQNCQTFSSLSCLSAGTEDCGPQSPFARHVSNTRAWTALLSASGPGGRTPAGTPVPEPLPPSFDDHLACQEDLSCEESDSCALDEDCGRRAEPAAAWRDRGAPGNSLCSLDGELDIEQIEKN

SEQ ID NO: 12428 - protein, 422 aa, Homo sapiens; identical to SEQ ID NO: 12427

SEQ ID NO: 12429 - protein, 392 aa, Homo sapiens
MITLITEQLQKQTLDELKCTRFSISLPLPDHADISNCGNSFQLVSEGASWRGLPHCSCAEFQDSLNFSYHPSGLSLHLRPPSRGNSPKEQPFSQVLRPEPPDPEKLPVPPAPPSKRHCRSLSVPVDLSRWQPVWRPAPSKLWTPIKHRGSGGGGGPQVPHQSPPKRVSSLRFLQAPSASSQCAPAHRPYSPPFFSLALAQDSSRPCAASPQSGSWESDAESLSPCPPQRRFSLSPSLGPQASRFLPSARSSPASSPELPWRPRGLRNLPRSRSQPCDLDARKTGVKRRHEEDPRRLRPSLDFDKMNQKPYSGGLCLQETAREGSSISPPWFMACSPPPLSASCSPTGGSSQVLSESEEEEEGAVRWGRQALSKRTLCQRDFGDLDLNLIEEN

SEQ ID NO: 12430 - protein, 392 aa, Homo sapiens; identical to SEQ ID NO: 12429

SEQ ID NO: 12431 - protein, 385 aa, Homo sapiens
MSLILNILREMLEYFGVPVEQVLLIWENKDYGSTRSIVRIIGKMLPLEPCRRPNFELIPLLNSVDSDNCGSMVPSFADILYVANDEEASYLRFRNSIWKNEEEKVEIFHPLRLVRDPLSPAVRQKETVKNDLPVNEAAIRKIAALENELTFLRSQIAAIVEMQELKNSTNSSSFGLSDERISLGQLSSSRAAHLSVDPDQLPGSVLSPPPPPPLPPQFSSLQPPCFPPVQPGSNNICDSDNPATEMSKQNPAANKTNYSHHSKSQRNKDIPNMLDVLKDMNKVKLRAIERSPGGRPIHKRKRQNSHWDPVSLISHALKQKFAFQEDDSFEKENRSWESSPFSSPETSRFGHHISQSEGQRTKEEMVNTKAVDQGISNTSLLNSRI

SEQ ID NO: 12432 - protein, 385 aa, Homo sapiens; identical to SEQ ID NO: 12431

SEQ ID NO: 12433 - protein, 292 aa, Homo sapiens
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAASASLTPDFLSPGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 12434 - protein, 292 aa, Homo sapiens; identical to SEQ ID NO: 12433

SEQ ID NO: 12435 - protein, 292 aa, Homo sapiens; identical to SEQ ID NO: 12433

SEQ ID NO: 12436 - protein, 280 aa, Homo sapiens
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 12437 - protein, 152 aa, Homo sapiens
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAAS

SEQ ID NO: 12438 - protein, 205 aa, Homo sapiens
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAVTSPRRQRWRSLSFHQSPCFVLPALNVANQNTKLPAVRLKRMTASLCPRPAALQT

SEQ ID NO: 12439 - protein, 205 aa, Homo sapiens; identical to SEQ ID NO: 12438

SEQ ID NO: 12440 - protein, 110 aa, Homo sapiens
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGS

SEQ ID NO: 12441 - protein, 170 aa, Homo sapiens
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAASASLTPDFLSPGSSNVSSP

SEQ ID NO: 12442 - protein, 115 aa, Homo sapiens
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLL

SEQ ID NO: 12443 - protein, 664 aa, Homo sapiens
MHRMPDPGKFKLLEQARDVREPVRYFSSVEEVASVFPDRIFVMEAITFSVKVVSGEFSEDSEVYNFTLHAGDELTLMGQAEILCAKTTKERSRFTTLLRKLGRAGALAGVGGGGPASAGAAGGTGGGGARPVKGKMPCLICMNHRTNESLSLPFQCQGRFSTRSPLELQMQEGEHTVRAIIERVRLPVNVLVPSRPPRNPYDLHPVREGHCYKLVSIISKTVVLGLALRREGPAPLHFLLLTDTPRFALPQGLLAGDPRVERLVRDSASYCRERFDPDEYSTAVREAPAELAEDCASPRRARLCLPAPRAPGLARAPGPLAPAPAGEGDQEYVSPDWAAAPEPAAPPAEIPYEELWAHQGPEGLVRPPPGLDLISFGAAGPPRREPEAPPPPVPPKSEAVKEECRLLNAPPVPPRGGNGSGRLSSSPPVPPRFPKLQPVHSPSSSLSYYSSGLQDGAGSRSGSGSPSPDTYSLYCYPCTWGDCKEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 12444 - protein, 876 aa, Homo sapiens
MDPAPSLGCSLKDVKWSSVAVPLDLLVSTYRLPQIARLDNGECVEGLRENDYLLIHSCRQWTTITAHSLEEGHYVIGPKIEIPVHYAGQFKLLEQDRDIKEPVQYFNSVEEVAKAFPERVYVMEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEAVREECRLLNAPPVPPRSAKPLSTSPSIPPRTVKPARQQTRSPSPTLSYYSSGLHNISVTKTDTNPSESTPVSCYPCNRVKTDSVDLKSPFGSPSAEAVSSRLSWPNHYSGASESQTRSDFLLDPSRSYSYPRQKTPGTPKRNCPAPFDFDGCELLASPTSPVTAEFSSSVSGCPKSASYSLESTDVKSLAAGVTKQSTSCPALPPRAPKLVEEKVASETSPLPLKIDGAEEDPKSGSPDLSEDQYFVKKGMQDIFSASYPFSSPLHLQLAPRSCGDGSPWQPPADLSGLSIEEVSKSLRFIGLSEDVISFFVTEKIDGNLLVQLTEEILSEDFKLSKLQVKKIMQFINGWRPKI

SEQ ID NO: 12445 - protein, 875 aa, Homo sapiens
MDPAPSLGCSLKDVKWSSVAVPLDLLVSTYRLPQIARLDNGECVEGLRENDYLLIHSCRQWTTITAHSLEEGHYVIGPKIEIPVHYAGQFKLLEQDRDIKEPVQYFNSVEEVAKAFPERVYVMEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEAVREECRLLNAPPVPPRSAKPLSTSPSIPPRTVKPARQQTRSPSPTLSYYSSGLHNIVTKTDTNPSESTPVSCYPCNRVKTDSVDLKSPFGSPSAEAVSSRLSWPNHYSGASESQTRSDFLLDPSRSYSYPRQKTPGTPKRNCPAPFDFDGCELLASPTSPVTAEFSSSVSGCPKSASYSLESTDVKSLAAGVTKQSTSCPALPPRAPKLVEEKVASETSPLPLKIDGAEEDPKSGSPDLSEDQYFVKKGMQDIFSASYPFSSPLHLQLAPRSCGDGSPWQPPADLSGLSIEEVSKSLRFIGLSEDVISFFVTEKIDGNLLVQLTEEILSEDFKLSKLQVKKIMQFINGWRPKI

SEQ ID NO: 12446 - protein, 874 aa, Homo sapiens
MEKLAAGLAGLRWSMGAFPLDLIVSRCRLPTLACLGPGEYAEGVSERDILLIHSCRQWTTVTAHTLEEGHYVIGPKIDIPLQYPGKFKLLEQARDVREPVRYFSSVEEVASVFPDRIFVMEAITFSVKVVSGEFSEDSEVYNFTLHAGDELTLMGQAEILCAKTTKERSRFTTLLRKLGRAGALAGVGGGGPASAGAAGGTGGGGARPVKGKMPCLICMNHRTNESLSLPFQCQGRFSTRSPLELQMQEGEHTVRAIIERVRLPVNVLVPSRPPRNPYDLHPVREGHCYKLVSIISKTVVLGLALRREGPAPLHFLLLTDTPRFALPQGLLAGDPRVERLVRDSASYCRERFDPDEYSTAVREAPAELAEDCASPRRARLCLPAPRAPGLARAPGPLAPAPAGEGDQEYVSPDWAAAPEPAAPPAEIPYEELWAHQGPEGLVRPPPGLDLISFGAAGPPRREPEAPPPPVPPKSEAVKEECRLLNAPPVPPRGGNGSGRLSSSPPVPPRFPKLQPVHSPSSSLSYYSSGLQDGAGSRSGSGSPSPDTYSLYCYPCTWGDCKVGESSSRPAPGPLPSTTQPSQASRALTEPLSGRAASLLGADTPVKTYHSCPPLFKPSHPQKRFAPFGALNPFSGPAYPSGPSAALSSGPRTTSGPVATSGPAYSPGPASPGQAYSAAPPSSCAPSSSSSSEWQEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 12447 - protein, 221 aa, Homo sapiens
MFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQSPCYSNQSDDGSDTEMASGSNRTPVFSFLDLTYWKRQKICCGIIYKGRFGEVLIDTHLFKPCCSNKKAAAEKPEEQGPEPLPISTQEW

SEQ ID NO: 12448 - protein, 73 aa, Homo sapiens
MASGSNRTPVFSFLDLTYWKRQKICCGIIYKGRFGEVLIDTHLFKPCCSNKKAAAEKPEEQGPEPLPISTQEW

SEQ ID NO: 12449 - protein, 262 aa, Homo sapiens
MSYLPTNPPGSILAGSASLSAVTGVPEGEARFTEDYCPEEKMFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQSPCYSNQSDDGSDTEMASGSNRTPVFSFLDLTYWKRQKICCGIIYKGRFGEVLIDTHLFKPCCSNKKAAAEKPEEQGPEPLPISTQEW

SEQ ID NO: 12450 - protein, 221 aa, Homo sapiens; identical to SEQ ID NO: 12447

SEQ ID NO: 12451 - protein, 134 aa, Homo sapiens
MFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQS

SEQ ID NO: 12452 - protein, 127 aa, Homo sapiens
MFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTS

SEQ ID NO: 12453 - protein, 327 aa, Homo sapiens
MNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPETQLQVDQDYLIALSLQQQQPRGPLGLTDLELAQQLQQEEYQQQQAAQPVRMRTRVLSLQGRGATSGRPAGERRQRPKHESDCILL

SEQ ID NO: 12454 - protein, 517 aa, Homo sapiens
MLLGPPPFNESTKPSPSPCHSFASQAWLRQVPEVSKHLQCPSAKSLLTMEYHQPEDPAPGKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPETQLQVDQDYLIALSLQQQQPRGPLGLTDLELAQQLQQEEYQQQQAAQPVRMRTRVLSLQGRGATSGRPAGERRQRPKHESDCILL

SEQ ID NO: 12455 - protein, 469 aa, Homo sapiens
MEYHQPEDPAPGKAGTAEAVIPENHEVLAGPDEHPQDTDARDADGEAREREPADQALLPSQCGDNLESPLPEASSAPPGPTLGTLPEVETIRACSMPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPETQLQVDQDYLIALSLQQQQPRGPLGLTDLELAQQLQQEEYQQQQAAQPVRMRTRVLSLQGRGATSGRPAGERRQRPKHESDCILL

SEQ ID NO: 12456 - protein, 374 aa, Homo sapiens
MPQELPQSPRTRQPEPDFYCVKWIPWKGEQTPIITQSTNGPCPLLAIMNILFLQWKVKLPPQKEVITSDELMAHLGNCLLSIKPQEKSEGLQLNFQQNVDDAMTVLPKLATGLDVNVRFTGVSDFEYTPECSVFDLLGIPLYHGWLVDPQSPEAVRAVGKLSYNQLVERIITCKHSSDTNLVTEGLIAEQFLETTAAQLTYHGLCELTAAAKEGELSVFFRNNHFSTMTKHKSHLYLLVTDQGFLQEEQVVWESLHNVDGDSCFCDSDFHLSHSLGKGPGAEGGSGSPETQLQVDQDYLIALSLQQQQPRGPLGLTDLELAQQLQQEEYQQQQAAQPVRMRTRVLSLQGRGATSGRPAGERRQRPKHESDCILL

SEQ ID NO: 12457 - protein, 620 aa, Homo sapiens
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLRGQYKVTASPETAVAGVGHELGTAGDAGARPDLAGTCQAELTAAGSEEPSSAGGLSSSCSDPSPPGESPSLDSLESFSNLHSFPSSCEFNSEEGAENRVPEEEEGAAVLPGAVPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNVRFTGVRVFEYTPECIVFDLLDIPLYHGWLVDPQIDDIVKAVGNCSYNQLVEKIISCKQSDNSELVSEGFVAEQFLNNTATQLTYHGLCELTSTVQEGELCVFFRNNHFSTMTKYKGQLYLLVTDQGFLTEEKVVWESLHNVDGDGNFCDSEFHLRPPSDPETVYKGQQDQIDQDYLMALSLQQEQQSQEINWEQIPEGISDLELAKKLQEEEDRRASQYYQEQEQAAAAAAAASTQAQGQPAQASPSSGRQSGNSERKRKEPREKDKEKEKEKNSCVIL

SEQ ID NO: 12458 - protein, 621 aa, Homo sapiens
MESSPESLQPLEHGVAAGPASGTGSSQEGLQETRLAAGDGPGVWAAETSGGNGLGAAAARRSLPDSASPAGSPEVPGPCSSSAGLDLKDSGLESPAAAEAPLRGQYKVTASPETAVAGVGHELGTAGDAGARPDLAGTCQAELTAAGSEEPSSAGGLSSSCSDPSPPGESPSLDSLESFSNLHSFPSSCEFNSEEGAENRVPEEEEGAAVLPGAVPLCKEEEGEETAQVLAASKERFPGQSVYHIKWIQWKEENTPIITQNENGPCPLLAILNVLLLAWKVKLPPMMEIITAEQLMEYLGDYMLDAKPKEISEIQRLNYEQNMSDAMAILHKLQTGLDVNVRFTGVRVFEYTPECIVFDLLDIPLYHGWLVDPQIDDIVKAVGNCSYNQLVEKIISCKQSDNSELVSEGFVAEQFLNNTATQLTYHGLCELTSTVQEGELCVFFRNNHFSTMTKYKGQLYLLVTDQGFLTEEKVVWESLHNVDGDGNFCDSEFHLRPPSDPETVYKGQQDQIDQDYLMALSLQQEQQSQEINWEQIPEGISDLELAKKLQEEEDRRASQYYQEQEQAAAAAAAASTQAQQGQPAQASPSSGRQSGNSERKRKEPREKDKEKEKEKNSCVIL

SEQ ID NO: 12459 - protein, 946 aa, Homo sapiens
MSVRLRFLSPGDTGAVGVVGRSASFAGFSSAQSRRIAKSINRNSVRSRMPAKSSKMYGTLRKGSVCADPKPQQVKKIFEALKRGLKEYLCVQQAELDHLSGRHKDTRRNSRLAFYYDLDKQTRCVERHIRKMEFHISKVDELYEDYCIQCRLRDGASSMQRAFARCPPSRAARESLQELGRSLHECAEDMWLIEGALEVHLGEFHIRMKGLVGYARLCPGDHYEVLMRLGRQRWKLKGRIESDDSQTWDEEEKAFIPTLHENLDIKVTELRGLGSLAVGAVTCDIADFFTTRPQVIVVDITELGTIKLQLEVQWNPFDTESFLVSPSPTGKFSMGSRKGSLYNWTPPSTPSFRERYYLSVLQQPTQQALLLGGPRATSILSYLSDSDLRGPSLRSQSQELPEMDSFSSEDPRDTETSTSASTSDVGFLPLTFGPHASIEEEAREDPLPPGLLPEMAHLSGGPFAEQPGWRNLGGESPSLPQGSLFHSGTASSSQNGHEEGATGDREDGPGVALEGPLQEVLELLRPTDSTQPQLRELEYQVLGFRDRLKPCRARQEHTSAESLMECILESFAFLNADFALDELSLFGGSQGLRKDRPLPPPSSLKASSRELTAGAPELDVLLMVHLQVCKALLQKLASPNLSRLVQECLLEEVAQQKHVLETLSVLDFEKVGKATSIEEIIPQASRTKGCLKLWRGCTGPGRVLSCPATTLLNQLKKTFQHRVRGKYPGQLEIACRRLLEQVVSCGGLLPGAGLPEEQIITWFQFHSYLQRQSVSDLEKHFTQLTKEVTLIEELHCAGQAKVVRKLQGKRLGQLQPLPQTLRAWALLQLDGTPRVCRAASARLAGAVRNRSFREKALLFYTNALAENDARLQQAACLALKHLKGIESIDQTASLCQSDLEAVRAAARETTLSFGEKGRLAFEKMDKLCSEQREVFCQEADVEITIF

SEQ ID NO: 12460 - protein, 946 aa, Homo sapiens; identical to SEQ ID NO: 12459

SEQ ID NO: 12461 - protein, 950 aa, Homo sapiens
MVTTMSVRLRFLSPGDTGAVGVVGRSASFAGFSSAQSRRIAKSINRNSVRSRMPAKSSKMYGTLRKGSVCADPKPQQVKKIFEALKRGLKEYLCVQQAELDHLSGRHKDTRRNSRLAFYYDLDKQTRCVERHIRKMEFHISKVDELYEDYCIQCRLRDGASSMQRAFARCPPSRAARESLQELGRSLHECAEDMWLIEGALEVHLGEFHIRMKGLVGYARLCPGDHYEVLMRLGRQRWKLKGRIESDDSQTWDEEEKAFIPTLHENLDIKVTELRGLGSLAVGAVTCDIADFFTTRPQVIVVDITELGTIKLQLEVQWNPFDTESFLVSPSPTGKFSMGSRKGSLYNWTPPSTPSFRERYYLSVLQQPTQQALLLGGPRATSILSYLSDSDLRGPSLRSQSQELPEMDSFSSEDPRDTETSTSASTSDVGFLPLTFGPHASIEEEAREDPLPPGLLPEMAHLSGGPFAEQPGWRNLGGESPSLPQGSLFHSGTASSSQNGHEEGATGDREDGPGVALEGPLQEVLELLRPTDSTQPQLRELEYQVLGFRDRLKPCRARQEHTSAESLMECILESFAFLNADFALDELSLFGGSQGLRKDRPLPPPSSLKASSRELTAGAPELDVLLMVHLQVCKALLQKLASPNLSRLVQECLLEEVAQQKHVLETLSVLDFEKVGKATSIEEIIPQASRTKGCLKLWRGCTGPGRVLSCPATTLLNQLKKTFQHRVRGKYPGQLEIACRRLLEQVVSCGGLLPGAGLPEEQIITWFQFHSYLQRQSVSDLEKHFTQLTKEVTLIEELHCAGQAKVVRKLQGKRLGQLQPLPQTLRAWALLQLDGTPRVCRAASARLAGAVRNRSFREKALLFYTNALAENDARLQQAACLALKHLKGIESIDQTASLCQSDLEAVRAAARETTLSFGEKGRLAFEKMDKLCSEQREVFCQEADVEITIF

SEQ ID NO: 12462 - protein, 422 aa, Homo sapiens
MKKNTSKTTMRINKQDALCTPHSHDPRDLQNMLDGGEYAPFVSPPMLESNFIQVNRRGESIYLHNRANWVTVGICFSSSTHKIPNVMLLAHLTPGAQKDTETLFKSLLTSPPAEKLVLTRFLPLQFVTLSVHDAENMSLKVKLVSGRAYYLQLCTSAYKQDTLFSQWVALISLLNQEKAKVSKVSEVSSLSGITNSTDITGSMDVTDVTTFTAILTPYMYAGTGPEHVRDSIDFPEFTDITDITDVTDLPENEVPEVPDVRIVTEVIEVREATEVTDSSDITNCSGVTVVFENNDLIRAKQEEKEKLKNILKPGCLQDTKSKSELKESSKHVTISNITLTFEGKRYFQTTLTPVESEANTSKEMKDKTSEEKMPDFQSTALKAEESRSLRTESNTSVLSPHIKSPSNFLKLVPHLSAPFSRE

SEQ ID NO: 12463 - protein, 594 aa, Homo sapiens
MNADFLLPYYTAQSGSSMSMFNTTMGKLQRQLYKGEYDIFKYAPIFESDFIQITKRGEVIDVHNRVRMVTMGIARTSPILPLPDVMLLARPATGCEEYAGHGQATKRKKRKAAKNLELTRLLPLRFVRISVQDHEKQQLRLKFATGRSCYLQLCPALDTRDDLFAYWEKLIYLLRPPMESNSSTCGIPAEDMMWMPVFQEDRRSLGAVNLQGKGDQDQVSIQSLHMVSEVCGATSAAYAGGEGLQNDFNKPTNVLNASIPKTSTELAEEPATGGIKEAAAAGAAAGAATGTVAGALSVAAANSAPGQVSAAIAGAATIGAGGNKGNMALAGTASMAPNSTKVAVAGAAGKSSEHVSSASMSLSREGSVSLAIAGVVLTSRTAAEADMDAAAGPPVSTRQSKSSLSGQHGRERTQASAEGCKEGRERREKDRALGRSSHRRRTGESRHKTRGDKIAQKSSSRSSFSHRANRDDKKEKGCGNPGSSRHRDSHKGVSHTPISKESRTSHKSGRSLWTTSSGSSKGLGRVSSFLRNVRANLTTKVVGTPHGRDVNVMAKMAERSTNVAIAETAEGGQGLETVGSMTPDIMETVTFEAH

SEQ ID NO: 12464 - protein, 369 aa, Homo sapiens
MVSEVCGATSAAYAGGEGLQNDFNKPTNVLNASIPKTSTELAEEPATGGIKEAAAAGAAAGAATGTVAGALSVAAANSAPGQVSAAIAGAATIGAGGNKGNMALAGTASMAPNSTKVAVAGAAGKSSEHVSSASMSLSREGSVSLAIAGVVLTSRTAAEADMDAAAGPPVSTRQSKSSLSGQHGRERTQASAEGCKEGRERREKDRALGRSSHRRRTGESRHKTRGDKIAQKSSSRSSFSHRANRDDKKEKGCGNPGSSRHRDSHKGVSHTPISKESRTSHKSGRSLWTTSSGSSKGLGRVSSFLRNVRANLTTKVVGTPHGRDVNVMAKMAERSTNVAIAETAEGGQGLETVGSMTPDIMETVTFEAH

SEQ ID NO: 12465 - protein, 241 aa, Homo sapiens
MEDCCMLPYYTAQSSPAMGMFNTSMGKLQRQLYKGEYTIFRYAPMFESDFIQISKRGEVIDVHNRARMVTMGIVRTSPCLTLPDVMLLARPAAVCDNARCGPATQKRESPPAEILELTRLLPLMFVKITIHNSVKKQLHLKLATGRSFYLQLCPPSDASEDLFVHWENLVYILRPPVEAYSDTRAILAGNTLDSSVLEEVQRSPVGYAMKFCEEKEQFRISRLHMNAEMFGSTYCDYTIEI

SEQ ID NO: 12466 - protein, 231 aa, Homo sapiens
MGPPLWPDLQEPPPPGTSSQIRSPLLCDVIKPAPHHDVTVRVVPPPRFLPLLLRPLPSDGDIAMRRDRGPKPALGGAGEVEPGGMAASPTGRPRRLQRYLQSGEFDQFRDFPIFESNFVQVTRLGEVANEVTMGVAASSPALELPDLLLLAGPAKENGHLQLFGLFPLKFVQLFVHDKSRCQLEVKLNTSRTFYLQLRAPLKTRDREFGQWVRLLYRLRFLSASAVPFTQE

SEQ ID NO: 12467 - protein, 247 aa, Homo sapiens
MGPPLWPDLQEPPPPGTSSQIRSPLLCDVIKPAPHHDVTVRVVPPPRFLPLLLRPLPSDGDIAMRRDRGPKPALGGAGEVEPGGMAASPTGRPRRLQRYLQSGEFDQFRDFPIFESNFVQFCPDIYPAPTSDLWPQVTRLGEVANEVTMGVAASSPALELPDLLLLAGPAKENGHLQLFGLFPLKFVQLFVHDKSRCQLEVKLNTSRTFYLQLRAPLKTRDREFGQWVRLLYRLRFLSASAVPFTQE

SEQ ID NO: 12468 - protein, 922 aa, Homo sapiens
MIWLRNRRCLEPLQGTPKWVPVLGELQKTLQKGEYLPLRPLPMFESNFVQVTHQGGPVFVNHRTNRLAMGVAASLPGLVLPDILLIGQPAEDRDCSGLVLTRMIPLDLVHLCVHDLSAWRLKLRLVSGRQYYLALDAPDNEVGFLFHCWVRLINLLQEPAPTWTPRTTRTAPLDMPLAEAPASTWHLQDQPISRHAVRVAERNFPHKTVAAQRQRKAKALKRSFKSQAVGDSVPLIWSQLEHADVRKKPAEKKSHSDPRPDRTHTQIRLPEKTSITTWTIFSIISSTANQTQSSPKACTSASDEATGQGHVVESPSHCVSADSPDGFFLGSCSSLDPCLWHQDTEDLMDSGGSTLSSAASGLAPYPPAACLSTPYSSIPRGREKAGPMGSHQGPGPPPCQKAPSGLVTSCKAPFLVDQSQKLPAVPASSWKPPPGLAPPQKAPAASAPPRKAPAVPAPSQKAPAVPAPSQKAPAIPAPSRKASAASASPRKASAVPAPPQKTPPPSQKAPSVPTIPQKAVSPTAPKKKSLLLPAPSQKALPTSPTEYQMALSPPASRGKLPGDFDVLPTGIPGRAVLERSQSGGKPEPVVTVRTQETDVVEMTTQAKSPESPFTVTKKESKDILISQTKEVTLEAFRGQGKLEDWAHWAKLEERSPDLPGVRSKELEQRKRWVKAKELAVEGPSQEHSRPFSVEALTLTKLMITANSKEQPSKSALVSLPSWLLATPQASATSMMASVPSRPGQLSLLEGKPVVVREQPESHTWVKEGKRPWGEMKEQPWGEMKEPPWDPKGPPKVPFRSKPTSASLKREGISQAPIPLTASPWEDLRPSPLSETLISKMEATARASQQPKRVSQEPMRMPAQHPLATVGSSSEILLPMLLELETVRNTATKAEEIQEESGVLNLLPSLQHSQHSEWPDAGA

SEQ ID NO: 12469 - protein, 344 aa, Homo sapiens
MLSSFPHRKTWRKSKKTVKVTRSYPTFPSLNAWEEFRGLLPVDGEPNPGAGLGVEEGLLCRVVHSPEFNLFLDSVVFESNFIQVKRGRNWRDVYKASNTMALGVTSSVPCLPLPNILLMASVKWHQGQNQTWNRPSIAPNIFLKRILPLRFVELQVCDHYQRILQLRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLSFRSSRKVETNKNSSGKDSSREDSIPCTCDLRWRASFTYGEWERENPSGLQPLSLLSTLAASTGPQLAPPIGNSI

SEQ ID NO: 12470 - protein, 300 aa, Homo sapiens
MSKIRGLPPEVREPGPGVELGVENGLLCQLIHSPEFNLFSNSVVFESNFIQVTKPGNWRDVCEGSATVILGVTSSVPSLPLPNVLLMANVTWPQGPFTTWSTPGDAPVINLSRLLPLKYVELRIYDRLQRILRVRTVTEKIYYLKLHEKHPEIVFQFWVRLVKILQKGLSITTKDPRIKFTHCLVPKMPTNSTETTPENSLLSSPQPSEPLVLLAAEQTSGSFSQLSGKPQLTADRNNDTAIEIDNCSSYKIPSPVASPINLNIPMRAALSHSLWEQEDWNEHLLQVHIASYLGEHFLGA

SEQ ID NO: 12471 - protein, 300 aa, Homo sapiens; identical to SEQ ID NO: 12470

SEQ ID NO: 12472 - protein, 300 aa, Homo sapiens; identical to SEQ ID NO: 12470

SEQ ID NO: 12473 - protein, 309 aa, Homo sapiens
MSKIRGLPPEVREPGPGVELGVENGLLCQLIHSPEFNLFSNSVVFESNFIQTHVPEADFQVTKPGNWRDVCEGSATVILGVTSSVPSLPLPNVLLMANVTWPQGPFTTWSTPGDAPVINLSRLLPLKYVELRIYDRLQRILRVRTVTEKIYYLKLHEKHPEIVFQFWVRLVKILQKGLSITTKDPRIKFTHCLVPKMPTNSTETTPENSLLSSPQPSEPLVLLAAEQTSGSFSQLSGKPQLTADRNNDTAIEIDNCSSYKIPSPVASPINLNIPMRAALSHSLWEQEDWNEHLLQVHIASYLGEHFLGA

SEQ ID NO: 12474 - protein, 109 aa, Homo sapiens
MSTNICSFKDSAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 12475 - protein, 149 aa, Homo sapiens
MSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 12476 - protein, 149 aa, Homo sapiens
MPTTTALRWTAAARVRRKGRGGWVPAALRSVSQDGVPGCTVMGGETRSPENAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 12477 - protein, 109 aa, Homo sapiens
MSTNICSFKDSAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 12478 - protein, 149 aa, Homo sapiens
MSTNICSFKDRCVSILCCKFCKQVLSSRGMKAVLLADTEIDLFSTDIPPTNAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 12479 - protein, 120 aa, Homo sapiens
MKAVLLADTEIDLFSTDIPPTNAVDFTGRCYFTKICKCKLKDIACLKCGNIVGYHVIVPCSSCLPSCNNGHFWMFHSQAVYDINRLDSTGVNILLWGNLPEIEESTDEDVLNISAEECIR

SEQ ID NO: 12480 - protein, 120 aa, Homo sapiens; identical to SEQ ID NO: 12479

SEQ ID NO: 12481 - protein, 73 aa, Homo sapiens
  MOD_RES (1)..(1): Any amino acid
XGNIVVYHVIVPCSSCLLSCNNRHFWMFHSQAVYDINRLDSTGVNVLLRGNLPEIEESTDEDVLNISAEECIR

SEQ ID NO: 12482 - protein, 149 aa, Homo sapiens
MSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNRHFWMFHSQAVYDINRLDSTGVNVLLRGNLPEIEESTDEDVLNISAEECIR

SEQ ID NO: 12483 - protein, 182 aa, Homo sapiens
MKPWWARDWALPSRGQCVCPGETNACLDAERACRECPRGLEETWDLLSQLQSLLGTHLDKGDFGQLSGPEPPGEVGKRAPDGASRSSLEPMEDAAPIIYLLASPDPRIKHPQDLASTPSPGPMTTSVSSLSASQPPEPSLLLERPSPKPPALFLTHHTPLILWPALLLLQKTSLLLPCGTPL

SEQ ID NO: 12484 - protein, 341 aa, Homo sapiens
MAALYACTKCHQRFPFEALSQGQQLCKECRIAHPVVKCTYCRTEYQQERLECNGTISAHCNLHLPGSSDSPASSSRVAGITGIKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSQKTLSTSSIQNEIPKKKSKFESITTNGDSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 12485 - protein, 312 aa, Homo sapiens
MAALYACTKCHQRFPFEALSQGQQLCKECRIAHPVVKCTYCRTEYQQERLECNGTISAHCNLHLPGSSDSPASSSRVAGITGIKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 12486 - protein, 278 aa, Homo sapiens
MAALYACTKCHQRFPFEALSQGQQLCKECRIAHPVVKCTYCRTEYQQESKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 12487 - protein, 307 aa, Homo sapiens
MAALYACTKCHQRFPFEALSQGQQLCKECRIAHPVVKCTYCRTEYQQESKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSQKTLSTSSIQNEIPKKKSKFESITTNGDSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 12488 - protein, 227 aa, Homo sapiens
MAALYACTKCHQRFPFEALSQGQQLCKECRIAHPVVKCTYCRTEYQQESKTNTICKKCAQNVQLYGTVDGKLLCWLCTLSYKRVLQKTKEQRKHLSSSSRAGHQEKEQYSRLSGGGHYNSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 12489 - protein, 339 aa, Homo sapiens
MAASALYACTKCTQRYPFEELSQGQQLCKECRIAHPIVKCTYCRSEFQQESKTNTICKKCAQNVKQFGTPKPCQYCNIIAAFIGTKCQRCTNSEKKYGPPQTCEQCKQQCAFDRKEEGRRKVDGKLLCWLCTLSYKRVLQKTKEQRKSLGSSHSNSSSSSLTEKDQHHPKHHHHHHHHHHRHSSSHHKISNLSPEEEQGLWKQSHKSSATIQNETPKKKPKLESKPSNGDSSSINQSADSGGTDNFVLISQLKEEVMSLKRLLQQRDQTILEKDKKLTELKADFQYQESNLRTKMNSMEKAHKETVEQLQAKNRELLKQVAALSKGKKFDKSGSILTSP

SEQ ID NO: 12490 - protein, 280 aa, Homo sapiens
MTSYILISFVLLIGVGCIEKDQSCPVFGGRKRLHLLFVGGQLRQVRMLRGSPEASTDCCWLHQATGSGSVTQAGVQWYDLGSLQPLPPRFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 12491 - protein, 283 aa, Homo sapiens
MPGFFCDCWPSLEIRALLYAMGCIQSIGGKARVFREGITVIDVKASIDPVPTSIDESSSVVLRYRTPHFRASAQVVMPPIPKKETWVVGWIQACSHMEFYNQYGEQGMSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 12492 - protein, 252 aa, Homo sapiens
GQGIAAALIHLPSTGNKHWRPRSPEASTDCCWLHQATGSGSVTQAGVQWYDLGSLQPLPPRFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 12493 - protein, 261 aa, Homo sapiens
MGCIQSITCKARIRRENIVVYDVCATIDQCPTRIEETSPIVLRYKTPYFKASARVVMPPIPRHETWVVGWIQACNQMEFFNTYSDLGMSSWELPDLREGRVKAISDSDGVSYPWYGNTTETVTLVGPTNKISRFSVSMNDNFYPSVTWAVPVSDSNVPLLTRIKRDQSFTTWLVAMNTTTKEKIILQTIKWRMRVDIEVDPLQLLGQRARLVGRTQQEQPRILSRMEPIPPNALVKPNANDAQVLMWRPKRGPPLVVIPPK

SEQ ID NO: 12494 - protein, 261 aa, Homo sapiens; identical to SEQ ID NO: 12493

SEQ ID NO: 12495 - protein, 368 aa, Homo sapiens
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLRGRVARCDASIARLSAEHKTTYEGLQHLNKEQQAAKLILETKIKDAEGQISQLLNRVDLSISEQSTKLKMSHRDSNHQLQLLDTKFKGTVEELSNQILSARSWLQQEQERIEKELLQKIDQLSLIVKENSGASERDMEKKLSQMSARLDKIEEGQKKTFDGQRTRQEEEKMHGRITKLELQMNQNIKEMKAEVNAGFTAVYESIGSLRQVLEAKMKLDRDQLQKQIQLMQKPETPM

SEQ ID NO: 12496 - protein, 68 aa, Homo sapiens
MENMHLRRVRTMPRHSQSLTMAPYSSVSLVEQLEDRILCHEKTTAALVEHAFRIKDDIVNSLQKMQNK

SEQ ID NO: 12497 - protein, 108 aa, Homo sapiens
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARD

SEQ ID NO: 12498 - protein, 67 aa, Homo sapiens
MENMHLRRVRTMPRHSQSLTMAPYSSVSLVEQLEDRILCHEKTTAALVEHAFRIKDDIVNSLQKMQN

SEQ ID NO: 12499 - protein, 115 aa, Homo sapiens
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTN

SEQ ID NO: 12500 - protein, 58 aa, Homo sapiens
MENMHLRRVRTMPRHSQSLTMAPYSSVSLVEQLEDRILCHEKTTAALVEHAFRIKDDI

SEQ ID NO: 12501 - protein, 133 aa, Homo sapiens
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLR

SEQ ID NO: 12502 - protein, 116 aa, Homo sapiens
MENMHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNS

SEQ ID NO: 12503 - protein, 452 aa, Homo sapiens
MQLQFLGTLASSEKRKKSQRLFFKNIKSTKNKAGKASIMSSDTNVNKSASPTATAEEQPVEPDGPLPGSDNNQEKKVRLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEILEDQIRARDQAATGTNFAVHEINIKHLQGVGDLRGRVARCDSSIVKLSGDIHLFRQEHRQIEKAIQEFVPALETLSKNLDMKVMQLLGKIETASPEQTSNLKMVQGDYRHEMNLLEFKFHSLSSNLYEEVENNKKWTENQFLKYRKDHLGHINECLKVLQEKLEKSENKMEEKLLQLSSKVENFINTQKQETQLSKVKHMENKLSKKMEQMEKQIWGELETMQNEYQSGFKSIHDSLSSLQQIQKTKMDLEKYKVQKDLKKLQRKIVELQEV

SEQ ID NO: 12504 - protein, 367 aa, Homo sapiens
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQVLVILMDVFTDVEIFCDILEAANKRGVFVCVLLDQGGVKLFQEMCDKVQISDSHLKNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPVPESKQNKTKTKKQTTLWFLMAF

SEQ ID NO: 12505 - protein, 434 aa, Homo sapiens
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQVLVILMDVFTDVEIFCDILEAANKRGVFVCVLLDQGGVKLFQEMCDKVQISDSHLKNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPGTRSVSASSGPCSPAAPHPPPPPRFQPHQGPWGAPSPQAHLSPRPHDGPPAAVYSNLGAYRPTRLQLEQLGLVPRLTPTWRPFLQASPHF

SEQ ID NO: 12506 - protein, 434 aa, Homo sapiens; identical to SEQ ID NO: 12505

SEQ ID NO: 12507 - protein, 294 aa, Homo sapiens
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPGTRTDG

SEQ ID NO: 12508 - protein, 367 aa, Homo sapiens; identical to SEQ ID NO: 12504

SEQ ID NO: 12509 - protein, 294 aa, Homo sapiens; identical to SEQ ID NO: 12507

SEQ ID NO: 12510 - protein, 1011 aa, Homo sapiens
METSSMLSSLNDECKSDNYIEPHYKEWYRVAIDILIEHGLEAYQEFLVQERVSDFLAEEEINYILKNVQKVAQSTAHGTDDSCDDTLSSGTYWPVESDVEAPNLDLGWPYVMPGLLGGTHIDLLFHPPRAHLLTIKETIRKMIKEARKVIALVMDIFTDVDIFKEIVEASTRGVSVYILLDESNFNHFLNMTEKQGCSVQRLRNIRVRTVKGQDYLSKTGAKFHGKMEQKFLLVDCQKVMYGSYSYMWSFEKAHLSMVQIITGQLVESFDEEFRTLYARSCVPSSFAQEESARVKHGKALWENGTYQHSVSSLASVSSQRNLFGRQDKIHKLDSSYFKNRGIYTLNEHDKYNIRSHGYKPHFVPNFNGPNAIRQFQPNQINENWKRHSYAGEQPETVPYLLLNRALNRTNNPPGNWKKPSDSLSVASSSREGYVSHHNTPAQSFANRLAQRKTTNLADRNSNVRRSFNGTDNHIRFLQQRMPTLEHTTKSFLRNWRIESYLNDHSEATPDSNGSALGDRFEGYDNPENLKANALYTHSRLRSSLVFKPTLPEQKEVNSCTTGSSNSTIIGSQGSETPKEVPDTPTNVQHLTDKPLPESIPKLPLQSEAPKMHTLQVPENHSVALNQTTNGHTESNNYIYKTLGVNKQTENLKNQQTENLLKRRSFPLFDNSKANLDPGNSKHYVYSTLTRNRVRQPEKPKEDLLKSSKSMHNVTHNLEEDEEEVTKRNSPSGTTTKSVSIAALLDVNKEESNKELASKKEVKGSPSFLKKGSQKLRSLLSLTPDKKENLSKNKAPAFYRLCSSSDTLVSEGEENQKPKKSDTKVDSSPRRKHSSSSNSQGSIHKSKEDVTVSPSQEINAPPDENKRTPSPGPVESKFLERAGDASAPRFNTEQIQYRDSREINAVVTPERRPTSSPRPTSSELLRSHSTDRRVYSRFEPFCKIESSIQPTSNMPNTSINRPEIKSATMGNSYGRSSPLLNYNTGVYRSYQPNENKFRGFMQKFGNFIHKNK

SEQ ID NO: 12511 - protein, 747 aa, Homo sapiens
MFGGPGPGVLGAQGMAGPLRGRVEELKLPWWRESSPLVLRHSEAARLAADALLERGEAAYLRVISEERELPFLSALDVDYMTSHVRGGPELSEAQGQEASGPDRLSLLSEVTSGTYFPMASDIDPPDLDLGWPEVPQATGFSPTQAVVHFQRDKAKNIKDLLRFLFSQAHTVVAVVMDIFTDMELLCDLMEASSRRGVPVYLLLAQEHLRHFLEMCYKMDLNGEHLPNMRVRSTCGDTYCSKAGRRFTGQALEKFVLIDCEQVVAGSYSFTWLCSQAHTSMVLQLRGRIVEDFDREFRCLYAESQPVEGFCGGEDPLSPRALRPPPVALAFRPDVPSPTSSLPSSTSLSSIKQSPLMGRSSYLALPGGGDCSDTGVVSSSLGPARREASGQPSLHRQLSDPNHGSPPGLYRANLGKLGAYPWSQSSPALNHNSTSPLTLAVGSPLLPRSRPLLQFHRGAPALSRFPENGLPGSQEPSPLRGRWVPGTTLETVEEKEKKASPSQSRGQLDLLVPFPRAREVGDPDSGVTPNSGPLRPGEQAPEDRRLSPSQADSQLDLLSRALGTGGAPELGSLRPGDRALEDRRLSLNQSRGQSDLLMQYPKAQGSRVPLETNSSARPARRAPDERRQTLGHSQLDLITKFGPFRGEGPGPNGLPISSPARTAGAGSGDEKRLTLGHSKLDLITKYHQLHGARQGTEPGGPKGGHLNGGNSDLVRDEKRLTLGHSKLDLITKYNKSKFKQLRSRFES

SEQ ID NO: 12512 - protein, 478 aa, Homo sapiens
MAASQLAALEGVDSGPRVPGASPGFLYSEGQRLALEALLSKGAEAFQTCVQREELWPFLSADEVQGLAAAAEDWTVAKQEPSGMAEGATTTDVDAGSLSYWPGQSEQPAPVLRLGWPVDSAWKGITRAQLYTQPPGEGQPPLKELVRLEIQAAHKLVAVVMDVFTDPDLLLDLVDAATRRWVPVYLLLDRQQLPAFLELAQQLGVNPWNTENVDVRVVRGCSFQSRWRRQVSGTVREKFVLLDGERVISGSYSFTWSDARLHRGLVTLLTGEIVDAFSLEFRTLYAASCPLPPAPPQKPSVIGGLQRGRSPHRVSRRRSVAPASPPPPDGPLAHRLAACRVSPATPGPALSDILRSVQRARTPSGPPARPSRSMWDLSRLSQLSGSSDGDNELKKSWGSKDTPAKALMRQRGTGGGPWGEVDSRPPWGGALPLPPAHRLRYLSPARRRFGGDATFKLQEPRGVRPSDWAPRAGLGGQP

SEQ ID NO: 12513 - protein, 500 aa, Homo sapiens
MAESQLNCLDEAHVNEKVTEAQAAFYYCERRRAALEALLGGGEQAYRERLKEEQLRDFLSSPERQALRAAWSPYEDAVPAANARGKSKAKAKAPAPAPAESGESLAYWPDRSDTEVPPLDLGWTDTGFYRGVSRVTLFTHPPKDEKAPHLKQVVRQMIQQAQKVIAVVMDLFTDGDIFQDIVDAACKRRVPVYIILDEAGVKYFLEMCQDLQLTDFRIRNIRVRSVTGVGFYMPMGRIKGTLSSRFLMVDGDKVATGSYRFTWSSSHVDRNLLLLLTGQNVEPFDTEFRELYAISEEVDLYRQLSLAGRVGLHYSSTVARKLINPKYALVSGCRHPPGEMMRWAARQQREAGGNPEGQEEGASGGESAWRLESFLKDLVTVEQVLPPVEPIPLGELSQKDGRMVSHMHRDLKPKSREAPSRNGMGEAARGEAAPARRFSSRLFSRRAKRPAAPNGMASSVSTETSEVEFLTGKRPNENSSADISGKTSPSSAKPSNCVIS

SEQ ID NO: 12514 - protein, 823 aa, Homo sapiens
MAFSQVQCLDDNHVNWRSSESKPEFFYSEEQRLALEALVARGRDAFYEVLKRENIRDFLSELELKRILETIEVYDPGSEDPRGTGPSQGPEDNGVGDGEEASGADGVPIEAEPLPSLEYWPQKSDRSIPQLDLGWPDTIAYRGVTRASVYMQPPIDGQAHIKEVVRKMISQAQKVIAVVMDMFTDVDIFKDLLDAGFKRKVAVYIIVDESNVKYFLHMCERACMHLGHLKNLRVRSSGGTEFFTRSATKFKGALAQKFMFVDGDRAVCGSYSFTWSAARTDRNVISVLSGQVVEMFDRQFQELYLMSHSVSLKGIPMEKEPEPEPIVLPSVVPLVPAGTVAKKLVNPKYALVKAKSVDEIAKISSEKQEAKKPLGLKGPALAEHPGELPELLPPIHPGLLHLERANMFEYLPTWVEPDPEPGSDILGYINIIDPNIWNPQPSQMNRIKIRDTSQASAQHQLWKQSQDSRPRPEPCPPPEPSAPQDGVPAENGLPQGDPEPLPPVPKPRTVPVADVLARDSSDIGWVLELPKEEAPQNGTDHRLPRMAGPGHAPLQRQLSVTQDDPESLGVGLPNGLDGVEEEDDDDYVTLSDQDSHSGSSGRGPGPRRPSVASSVSEEYFEVREHSVPLRRRHSEQVANGPTPPPRRQLSAPHITRGTFVGPQGGSPWAQSRGREEADALKRMQAQRSTDKEAQGQQFHHHRVPASGTRDKDGFPGPPRYRSAADSVQSSTRNAGPAMAGPHHWQAKGGQVPRLLPDPGSPRLAQNARPMTDGRATEEHPSPFGIPYSKLSQSKHLKARTGGSQWASSDSKRRAQAPRDRKDP

SEQ ID NO: 12515 - protein, 823 aa, Homo sapiens; identical to SEQ ID NO: 12514

SEQ ID NO: 12516 - protein, 272 aa, Homo sapiens
MAFSQVQCLDDNHVNWRSSESKPEFFYSEEQRLALEALVARGRDAFYEVLKRENIRDFLSELELKRILETIEVYDPGSEDPRGTGPSQGPEDNGVGDGEEASGADGVPIEAEPLPSLEYWPQKSDRSIPQLDLGWPDTIAYRGVTRASVYMQPPIDGQAHIKEVVRKMISQAQKVIAVVMDMFTDVDIFKDLLDAGFKRKVAVYIIVDESNVKYFLHMCERACMHLGHLKNLRVRSSGGTEFFTRSATKFKGALAQKFMFVDGDRAVCGSYR

SEQ ID NO: 12517 - protein, 292 aa, Homo sapiens
MGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQPAPEPPAPAPHWAVYVGGGQIIHLHQGEIRQDSLYEAGAANVGRVVNSWYRYRPLVAELVVQNACGHLGLKSEEICWTNSESFAAWCRFGKREFKAGGEVPAGTQPPQQQYYLKVHLGENKVHTARFHSLEDLIREKRRIDASGRLRVLQELADLVDDKE

SEQ ID NO: 12518 - protein, 292 aa, Homo sapiens; identical to SEQ ID NO: 12517

SEQ ID NO: 12519 - protein, 355 aa, Homo sapiens
MGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQPAPEPPAPAPHWWASRARRSAGRTRRASPPGAALASGSSRREGRCRQARSPRSSSTISRCTWERTRSTPPGFTAWKTSSARSAVSTPAAACECSRSSPTSWTTRSSRLGAAGPSASPAPRSLPFPAPGLRSQRFSTSAPPRHARPPPVARARAAPPHPQASGRKSQELPQGRKGAAASAWLTATAVVTVLGDPACAFPLRCKPGTGKGLRGERTWPSPRVHGQ

SEQ ID NO: 12520 - protein, 197 aa, Homo sapiens
MHLFQSERWPSGRRPKRLRGHRAASALRTRRPAGAAVAAARAGAARARPALGRLRGRRADHPPAPRRDPPGQPEAGAANVGRVVNSWYRYRPLVAELVVQNACGHLGLKSEEICWTNSESFAAWCRFGKREFKAGGEVPAAAPAAAVLSQGAPGREQGPHRFHSLEDLIREKRYRRQRPPASAPGARRPRGRQGVAA

SEQ ID NO: 12521 - protein, 330 aa, Homo sapiens
MAPEENAGTELLLQSFERRFLAARTLRSFPWQSLEAKLRDSSDSELLRDILHKTVKHPVCVKHPPSVKYARCFLSELIKKHEAVHTEPLDELYEALAETLMAKESTQGHRSYLLPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 12522 - protein, 296 aa, Homo sapiens
MAPEENAGTELLLQSFERRFLAARTLRSFPWQSLEAKLRDSSDSELLRDILHKTVKHPVCVKHPPSVKYARCFLSELIKKPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 12523 - protein, 129 aa, Homo sapiens
MPPSTLQNGPSRTRQPSLTDVLYCPEAIVSLVGVLQRLAACREHKRAPEVYVAFTVRNPETCQLFTTELGEPPRPPGPTWCPSCPCRTPVEVKELGAGEKLGCSTLPHYAGNSGRGRPGWDQMGSGSSS

SEQ ID NO: 12524 - protein, 153 aa, Homo sapiens
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRRAVLPRSHRVAGRGPAEAGCLPGAQAGS

SEQ ID NO: 12525 - protein, 330 aa, Homo sapiens
MAPEENAGTELLLQGFERRFLAVRTLRSFPWQSLEAKLRDSSDSELLRDILQKTVRHPVCVKHPPSVKYAWCFLSELIKKHEAVHTEPLDKLYEVLTETLMAKESTQGHRSYLLSSGGSVTLSKSTAIISHGTTGLVTWDAALYLAEWAIENPAAFINRTVLELGSGAGLTGLAICKMCRPRAYIFSDPHSRVLEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLTL

SEQ ID NO: 12526 - protein, 296 aa, Homo sapiens
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRTVLELGSGAGLTGLAICKMCRPRAYIFSDPHSRVLEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLTL

SEQ ID NO: 12527 - protein, 153 aa, Homo sapiens; identical to SEQ ID NO: 12524

SEQ ID NO: 12528 - protein, 330 aa, Homo sapiens
MAPEENAGTELLLQGFERRFLAVRTLRSFPWQSLEAKLRDSSDSELLRDILQKTVRHPVCVKHPPSVKYAWCFLSELIKKHEAVHTEPLDKLYEVLAETLMAKESTQGHRSYLLSSGGSVTLSKSTAIISHGTTGLVTWDAALYLAEWAIENPAAFINRTVLELGSGAGLTGLAICKMCRPRAYIFSDPHSRILEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLTL

SEQ ID NO: 12529 - protein, 153 aa, Homo sapiens; identical to SEQ ID NO: 12524

SEQ ID NO: 12530 - protein, 296 aa, Homo sapiens
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRTVLELGSGAGLTGLAICKMCRPRAYIFSDPHSRILEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLTL

SEQ ID NO: 12531 - protein, 129 aa, Homo sapiens; identical to SEQ ID NO: 12523

SEQ ID NO: 12532 - protein, 295 aa, Homo sapiens
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRTVLELGSGAGLTGLAICKMCRPRAYIFSDPHSRILEQLRGNVLLNGLSLEADITGNLDSPRVTVAQLDWDVAMVHQLSAFQPDVVIAADVLYCPEAIVSLVGVLQRLAACREHKRAPEVYVAFTVRNPETCQLFTTELGRDGIRWEAEAHHDQKLFPYGEHLEMAMLNLT

SEQ ID NO: 12533 - protein, 149 aa, Homo sapiens
MAPEENAGTELLLQGFERRFLAVRTLRSFPWQSLEAKLRDSSDSELLRDILQKTVRHPVCVKHPPSVKYAWCFLSELIKKSSGGSVTLSKSTAIISHGTTGLVTWDAALYLAEWAIENPAAFINRRAVLPRSHRVAGRGPAEAGCLPGA

SEQ ID NO: 12534 - protein, 131 aa, Homo sapiens
MAPEENAGSELLLQSFKRRFLAARALRSFRWQSLEAKLRDSSDSELLRDILQKTCCIAQKPSCRWSGSCGGWLPAGSTSGLLNSTWPLPSATQRCASCSPPSYAGLGSDGKRKLIMTRNCFPTESTWRWQS

SEQ ID NO: 12535 - protein, 165 aa, Homo sapiens
MAPEENAGSELLLQSFKRRFLAARALRSFRWQSLEAKLRDSSDSELLRDILQKHEAVHTEPLDELYEVLVETLMAKESTQGHRSYLLTCCIAQKPSCRWSGSCGGWLPAGSTSGLLNSTWPLPSATQRCASCSPPSYAGLGSDGKRKLIMTRNCFPTESTWRWQS

SEQ ID NO: 12536 - protein, 158 aa, Homo sapiens
MAPEENAGSELLLQSFKRRFLAARALRSFRWQSLEAKLRDSSDSELLRDILQKTVKHPVCVKHPPSVKYARCFLSELIKKTCCIAQKPSCRWSGSCGGWLPAGSTSGLLNSTWPLPSATQRCASCSPPSYAGLGSDGKRKLIMTRNCFPTESTWRWQS

SEQ ID NO: 12537 - protein, 184 aa, Homo sapiens
MSGARAAPGAAGNGAVRGLRVDGLPPLPKSLSGLLHSASGGGASGGWRHLERLYAQKSRIQDELSRGGPGGGGARAAALPAKPPNLDAALALLRKEMVGLRQLDMSLLCQLYSLYESIQEYKGACQAASSPDCTYALENGFFDEEEEYFQEQNSLHDRRDRGPPRDLSLPVSSLSSSDWILESI

SEQ ID NO: 12538 - protein, 176 aa, Homo sapiens
MNGLPSAEAPGGAGCALAGLPPLPRGLSGLLNASGGSWRELERVYSQRSRIHDELSRAARAPDGPRHAAGAANAGPAAGPRRPVNLDSALAALRKEMLWGLYESIQDYKHLCQDLSFCQDLSSSLHSDSSYPPDAGLSDDEEPPDASLPPDPPPLTVPQTHNARDQWLQDAFHISL

SEQ ID NO: 12539 - protein, 162 aa, Homo sapiens
MNGLPSAEAPGGAGCALAGLPPLPRGLSGLLNASGGSWRELERVYSQRSRVVLSTSTQRWPRCARRCCLQVGLRQLDMSLLCQLWGLYESIQDYKHLCQDLSFCQDLSSSLHSDSSYPPDAGLSDDEEPPDASLPPDPPPLTVPQTHNARDQWLQDAFHISL

SEQ ID NO: 12540 - protein, 154 aa, Homo sapiens
MNGLPSAEAPGGAGCALAGLPPLPRGLSGLLNASGGSWRELERVYSQRSRIHDELSRAARAPDGPRHAAGAANAGPAAGPRRPVNLDSALAALRKEMLSAGGAAAVGHVLVVPAVGPVRVNPGLQTPVPRPELLPGPVILPPFGQLLPTGCGPV

SEQ ID NO: 12541 - protein, 189 aa, Homo sapiens
MNGLPSAEAPGGAGCALAGLPPLPRGLSGLLNASGGSWRELERVYSQRSRIHDELSRAARAPDGPRHAAGAANAGPAAGPRRPVNLDSALAALRKEMVGLRQLDMSLLCQLWGLYESIQDYKHLCQDLSFCQDLSSSLHSDSSYPPDAGLSDDEEPPDASLPPDPPPLTVPQTHNARDQWLQDAFHISL

SEQ ID NO: 12542 - protein, 838 aa, Homo sapiens
MNIDVEFHIRHNYPWNKLPANVRQSLGNSQREYEKQVVLYSIRNQLRYRNNLVKHVKKDERRYYEELLKYSRDHLMLYPYHLSDIMVKGLRITPFSYYTGIMEDIMNSEKSYDSLPNFTAADCLRLLGIGRNQYIDLMNQCRSSKKFFRRKTARDLLPIKPVEIAIEAWWVVQAGYITEDDIKICTLPEKCAVDKIIDSGPQLSGSLDYNVVHSLYNKGFIYLDVPISDDSCIAVPPLEGFVMNRVQGDYFETLLYKIFVSIDEHTNVAELANVLEIDLSLVKNAVSMYCRLGFAHKKGQVINLDQLHSSWKNVPSVNRLKSTLDPQKMLLSWDGGESRSPVQEASSATDTDTNSQEDPADTASVSSLSLSTGHTKRIAFLFDSTLTAFLMMGNLSPNLKSHAVTMFEVGKLSDESLDSFLIELEKVQSTGEGEAQRYFDHALTLRNTILFLRHNKDLVAQTAQPDQPNYGFPLDLLRCESLLGLDPATCSRVLNKNYTLLVSMAPLTNEIRPVSSCTPQHIGPAIPEVSSVWFKLYIYHVTGQGPPSLLLSKGTRLRKLPDIFQSYDRLLITSWGHDPGVVPTSNVLTMLNDALTHSAVLIQGHGLHGIGETVHVPFPFDETELQGEFTRVNMGVHKALQILRNRVDLQHLCGYVTMLNASSQLADRKLSDASDERGEPDLASGSDVNGSTESFEMVIEEATIDSATKQTSGATTEADWVPLELCFGIPLFSSELNRKVCRKIAAHGLCRKESLQNLLHSSRKLSLQVLNFVHSFQEGASILDIHTEPSFSSLLSQSSCADMGVPLPAKNLIFKDGVLSEWSGRSPSSLLIANLHLQ

SEQ ID NO: 12543 - protein, 91 aa, Homo sapiens
MNIDVEFHIRHNYPWNKLPANVRQSLGNSQREYEKQVVLYSIRNQLRYRNNLVKHVKKDERRYYEELLKYSRDHLMLYPYHLSDSVCYVCL

SEQ ID NO: 12544 - protein, 272 aa, Homo sapiens
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVIAQAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQQEAGWAATCQTLI

SEQ ID NO: 12545 - protein, 251 aa, Homo sapiens
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVIAQAETELQRAAMDASRTSRHLEETINNFERQKMKDIKVFRNSLYAPDYSSRLDIVRANSKSPLQRSLSAKCVSGTGQVSTCRLRKDQQAEDDEDDELDVTEEENFLK

SEQ ID NO: 12546 - protein, 289 aa, Homo sapiens
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISQAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSTCRLRKDQQAEDDEDDELDVTEEENFLK

SEQ ID NO: 12547 - protein, 262 aa, Homo sapiens
MMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVIAQAETELQRAAMDASRTSRHLEETINNFERQKMKDIKTIFSEFITIEMLFHGKALEVYTAAYQNIQNIDEDEDLERWSFAMLPRLVLNSWGSSDPPALASQSVRFSEILCMHQIIHLV

SEQ ID NO: 12548 - protein, 102 aa, Homo sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIVGNLHF

SEQ ID NO: 12549 - protein, 160 aa, Homo sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 12550 - protein, 102 aa, Homo sapiens; identical to SEQ ID NO: 12548

SEQ ID NO: 12551 - protein, 518 aa, Homo sapiens
MECDLMETDILESLEDLGYKGPLLEDGALSQAVSAGASSPEFTKLCAWLVSELRVLCKLEENVQATNSPSEAEEFQLEVSGLLGEMNCPYLSLTSGDVTKRLLIQKNCLLLLTYLISELEAARMLCVNAPPKKAQEGGGSEVFQELKGICIALGMSKPPANITMFQFFSGIEKKLKETLAKVPPNHVGKPLLKKPMGPAHWEKIEAINQAIANEYEVRRKLLIKRLDVTVQSFGWSDRAKSQTEKLAKVYQPKRSVLSPKTTISVAHLLAARQDLSKILRTSSGSIREKTACAINKVLMGRVPDRGGRPNEIEPPPPEMPPWQKRQDGPQQQTGGRGGGRGGYEHSSYGGRGGHEQGGGRGGRGGYDHGGRGGGRGNKHQGGWTDGGSGGGGGYQDGGYRDSGFQPGGYHGGHSSGGYQGGGYGGFQTSSSYTGSGYQGGGYQQDNRYQDGGHHGDRGGGRGGRGGRGGRGGRAGQGGGWGGRGSQNYHQGGQFEQHFQHGGYQYNHSGFGQGRHYTS

SEQ ID NO: 12552 - protein, 519 aa, Homo sapiens
MECDLMETDILESLEDLGYKGPLLEDGALSQAVSAGASSPEFTKLCAWLVSELRVLCKLEENVQATNSPSEAEEFQLEVSGLLGEMNCPYLSLTSGDVTKRLLIQKNCLLLLTYLISELEAARMLCVNAPPKKAQEGGGSEVFQELKGICIALGMSKPPANITMFQFFSGIEKKKLKETLAKVPPNHVGKPLLKKPMGPAHWEKIEAINQAIANEYEVRRKLLIKRLDVTVQSFGWSDRAKSQTEKLAKVYQPKRSVLSPKTTISVAHLLAARQDLSKILRTSSGSIREKTACAINKVLMGRVPDRGGRPNEIEPPPPEMPPWQKRQDGPQQQTGGRGGGRGGYEHSSYGGRGGHEQGGGRGGRGGYDHGGRGGGRGNKHQGGWTDGGSGGGGGYQDGGYRDSGFQPGGYHGGHSSGGYQGGGYGGFQTSSSYTGSGYQGGGYQQDNRYQDGGHHGDRGGGRGGRGGRGGRGGRAGQGGGWGGRGSQNYHQGGQFEQHFQHGGYQYNHSGFGQGRHYTS

SEQ ID NO: 12553 - protein, 323 aa, Homo sapiens
MGPAHWEKIEAINQAIANEYEVRRKLLIKRLDVTVQSFGWSDRAKSQTEKLAKVYQPKRSVLSPKTTISVAHLLAARQDLSKILRTSSGSIREKTACAINKVLMGRVPDRGGRPNEIEPPPPEMPPWQKRQDGPQQQTGGRGGGRGGYEHSSYGGRGGHEQGGGRGGRGGYDHGGRGGGRGNKHQGGWTDGGSGGGGGYQDGGYRDSGFQPGGYHGGHSSGGYQGGGYGGFQTSSSYTGSGYQGGGYQQDNRYQDGGHHGDRGGGRGGRGGRGGRGGRAGQGGGWGGRGSQNYHQGGQFEQHFQHGGYQYNHSGFGQGRHYTS

SEQ ID NO: 12554 - protein, 433 aa, Homo sapiens
MRGPEPGPQPTMEGDVLDTLEALGYKGPLLEEQALTKAAEGGLSSPEFSELCIWLGSQIKSLCNLEESITSAGRDDLESFQLEISGFLKEMACPYSVLISGDIKDRLKKKEDCLKLLLFLSTELQASQILQNKKHKNSQLDKNSEVYQEVQAMFDTLGIPKSTTSDIPHMLNQVESKVKDILSKVQKNHVGKPLLKMDLNSEQAEQLERINDALSCEYECRRRMLMKRLDVTVQSFGWSDRAKVKTDDIARIYQPKRYALSPKTTITMAHLLAAREDLSKIIRTSSGTSREKTACAINKVLMGRVPDRGGRPNEIEPPPPEMPPWQKRQEGGGGRGGWGGGGGGGGRGGGGGGGGRGGWGGGGGGWGGGGGGGGGWGGGGGGGRGGFQGRGDYGGRGGYGGRGGYGGRGYGDPYGGGGGGGGGGGGGGGYRRY

SEQ ID NO: 12555 - protein, 330 aa, Homo sapiens
MRGPEPGPQPTMEGDVLDTLEALGYKGPLLEEQALTKAAEGGLSSPEFSELCIWLGSQIKSLCNLEESITSAGRDDLESFQLEISGFLKEMACPYSVLISGDIKDRLKKKEDCLKLLLFLSTELQASQILQNKKHKNSQLDKNSEVYQEVQAMFDTLGIPKSTTSDIPHMLNQVESKVKDILSKVQKNHVGKPLLKMDLNSEQAEQLERINDALSCEYECRRRMLMKRLDVTVQSFGWSDRAKVKTDDIARIYQPKRYALSPKTTITMAHLLAAREDLSKIIRTSSGTSREKTACAINKVGVSFSTVENELMISYLMFLQILVYFSFMSW

SEQ ID NO: 12556 - protein, 182 aa, Homo sapiens
MMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYILKVLCPT

SEQ ID NO: 12557 - protein, 353 aa, Homo sapiens
MAADGDWQDFYEFQEPARSLLDQENCNASPEPGAEAGAEAGGGADGFPAPACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYILKVLCPT

SEQ ID NO: 12558 - protein, 380 aa, Homo sapiens
MAADGDWQDFYEFQEPARSLLDQENCNASPEPGAEAGAEAGGGADGFPAPACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTRFSMEGISNVIQNGLRHTFGNSGGEKQYLTTVIPYEKKNGPPSVEDLQILTKILRAMKEDSEKVPSLLTDYILKVLCPT

SEQ ID NO: 12559 - protein, 140 aa, Homo sapiens
MIDQLQGTWKSISCENSEDYMKELGIGRASRKLGRLAKPTVTISTDGDVITIKTKSIFKNNEISFKLGEEFEEITPGGHKTKSKVTLDKESLIQVQDWDGKETTITRKLVDGKMVVESTVNSVICTRTYEKVSSNSVSNS

SEQ ID NO: 12560 - protein, 735 aa, Homo sapiens
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEGLNVLSRHKKLKELSVSECYRITDDGIQAFCKSSLILEHLDVSYCSQLSDMIIKALAIYCINLTSLSIAGCPKITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 12561 - protein, 456 aa, Homo sapiens
ILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEGLNVLSRHKKLKELSVSECYRITDDGIQAFCKSSLILEHLDVSYCSQLSDMIIKALAIYCINLTSLSIAGCPKITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 12562 - protein, 707 aa, Homo sapiens
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEAFCKSSLILEHLDVSYCSQLSDMIIKALAIYCINLTSLSIAGCPKITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 12563 - protein, 453 aa, Homo sapiens
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 12564 - protein, 690 aa, Homo sapiens
MTPELMIKACSFYTGHLVKTHFCTWRDIARTNENVVLAEKMNRAVTCYNFRLQKSVFHHWHSYMEDQKEKLKNILLRIQQIIYCHKLTIILTKWRNTARHKSKKKEDELILKHELQLKKWKNRLILKRAAAEESNFPERSSSEVFLVDETLKCDISLLPERAILQIFFYLSLKDVIICGQVNHAWMLMTQLNSLWNAIDFSSVKNVIPDKYIVSTLQRWRLNVLRLNFRGCLLRPKTFRSVSHCRNLQELNVSDCPTFTDESMRHISEGCPGVLCLNLSNTTITNRTMRLLPRHFHNLQNLSLAYCRRFTDKGLQYLNLGNGCHKLIYLDLSGCTQISVQGFRYIANSCTGIMHLTINDMPTLTDNCVKALVEKCSRITSLVFTGAPHISDCTFRALSACKLRKIRFEGNKRVTDASFKFIDKNYPNLSHIYMADCKGITDSSLRSLSPLKQLTVLNLANCVRIGDMGLKQFLDGPASMRIRELNLSNCVRLSDASVMKLSERCPNLNYLSLRNCEHLTAQGIGYIVNIFSLVSIDLSGTDISNEGLNVLSRHKKLKELSVSECYRITDDGIQITDSAMEMLSAKCHYLHILDISGCVLLTDQILEDLQIGCKQLRILKMQYCTNISKKAAQRMSSKVQQQEYNTNDPPRWFGYDREGNPVTELDNITSSKGALELTVKKSTYSSEDQAA

SEQ ID NO: 12565 - protein, 707 aa, Homo sapiens; identical to SEQ ID NO: 12562

SEQ ID NO: 12566 - protein, 735 aa, Homo sapiens; identical to SEQ ID NO: 12560

SEQ ID NO: 12567 - protein, 690 aa, Homo sapiens; identical to SEQ ID NO: 12564

SEQ ID NO: 12568 - protein, 453 aa, Homo sapiens; identical to SEQ ID NO: 12563

SEQ ID NO: 12569 - protein, 479 aa, Homo sapiens
MSSPGIDGDPKPPCLPRNGLVKLPGQPNGLGAASITKGTPATKNRPCQPPPPPTLPPPSLAAPLSRAALAGGPCTPAGGPASALAPGHPAERPPLATDEKILNGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVMLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCVRITDTGLSYLSTMSSLRSLYLRWCCQVQDFGLKHLLALGSLRLLSLAGCPLLTTTGLSGLVQLQELEELELTNCPGATPELFKYFSQHLPRCLVIE

SEQ ID NO: 12570 - protein, 479 aa, Homo sapiens; identical to SEQ ID NO: 12569

SEQ ID NO: 12571 - protein, 259 aa, Homo sapiens
MHAVPRGFGKKVRVGVQSCPPLLGPGVPPALLRVLVSAEEPALPGTPRADWVQLLLRHAPQRARHPQLAPTLQPRTECRGLGGGRHRPAGLPAAPDARTAAQRPYGLRAGQYRPAVPAVAVPVAGQPGHDGEGGVHARALRHVEALQAAEGPQAGAALLQRQRPVLPGAEPVPLAAAPVPGLSQRHPPARCRAGLHGSLPAGCHVPPVHRGVPRHLQEPAAVASPQLPGRAARVKRRHLPSAPRGPDRRHPGRPPGAPG

SEQ ID NO: 12572 - protein, 805 aa, Homo sapiens
MASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLRKAEDDIDSSILETLVASCCNLRHLNLSAAHHHSSEGLGRHLCQLLARLRHLRSLSLPVCSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRRWGEVTGRRPQLFTELREEPSARTSRATGRRQPCLPDSGVVCCPCGRPLAVSGIILVGVSPSLVVKTTCVYRVLFKNLDYASIFFLVCLFETESHSVVQAGVQWRDLSSLQPLLSGLQPQPPEQLENELEIGFSYCFVI

SEQ ID NO: 12573 - protein, 718 aa, Homo sapiens
MASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLRKAEDDIDSSILETLVASCCNLRHLNLSAAHHHSSEGLGRHLCQLLARLRHLRSLSLPVCSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRSFQAERPALNVVIFPLLHEGLTDVIRDVPLVHLDEITLFKSRVAEEPPNLWW

SEQ ID NO: 12574 - protein, 801 aa, Homo sapiens
MASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLRKAEDDIDSSILETLVASCCNLRHLNLSAAHHHSSEGLGRHLCQLLARLRHLRSLSLPVCSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRRWGEVTGRRPQLFTELREEPSARTSRATGRRQPCLPDSGVVCCPCGRPLAVSGIILVGVSPSLVVKTTCVYRVLFKNLDYASIFFLVCLFETESHSVVQAGVQWRDLSSLQPLLSGLQPQPPEQLGLQVCTTIPG

SEQ ID NO: 12575 - protein, 241 aa, Homo sapiens
MHITQLNRECLLHLFSFLDKDSRKSLARTCSQLHDVFEDPALWSLLHFRSLTELQKDNFLLGPALRSLSICWHSSRVQVCSIEDWLKSAFQRSICSRHESLVNDFLLRVCDRLSAVRSPRRREAPAPSSGTPIAVGPKSPRWGGPDHSEFADLRSGVTGARAAARRGLGSLRAERPSETPPAPGVSWGPPPPGAPVVISVKQEEGKQGRTGRRSHRAAPPCGFARTRVCPPTFPGADAFPQ

SEQ ID NO: 12576 - protein, 539 aa, Homo sapiens
MAAPASRQVRRRARAAPRPRSAEDWWWDRLAPRGSGYHLLQSDSMLLVLSEPGPARPRAQRRASRRTPRQPPRGPSAAAKPKAGLRSEAAAAPAPAPAPTPTPEEGPDAGWGDRIPLEILVQIFGLLVAADGPMPFLGRAARVCRRWQEAASQPALWHTVTLSSPLVGRPAKGGVKAEKKLLASLEWLMPNRFSQLQRLTLIHWKSQVHPVLKLVGECCPRLTFLKLSGCHGVTADALVMLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRELEQLHLGLYGTSDRLTLAKEGSPFLTQKWCHTLRELDLSGQGFSEKDLEQALAAFLSTPGGSHPALCSLNLRGTRVTPSTVSSVISSCPGLLYLNLESCRCLPRGLKRAYRGLEEVQWCLEQLLTSPSPS

SEQ ID NO: 12577 - protein, 533 aa, Homo sapiens
MAAPASRQVRRRARAAPRPRSAEDWWWDRLAPRGSGYHLLQSDSMLLVLSEPGPARPRAQRRASRRTPRQPPRGPSAAAKPKAGLRSEAAAAPAPAPAPTPTPEEGPDAGWGDRIPLEILVQIFGLLVAADGPMPFLGRAARVCRRWQEAASQPALWHTVTLSSPLVGRPAKGGVKAEKKLLASLEWLMPNRFSQLQRLTLIHWKSQLVGECCPRLTFLKLSGCHGVTADALVMLAKACCQLHSLDLQHSMVESTAVVSFLEEAGSRMRKLWLTYSSQTTAILGALLGSCCPQLQVLEVSTGINRNSIPLQLPVEALQKGCPQLQVLRLLNLMWLPKPPGRGVAPGPGFPSLEELCLASSTCNFVSNEVLGRLLHGSPNLRLLDLRGCARITPAGLQDLPCRELEQLHLGLYGTSDRLTLAKEGSPFLTQKWCHTLRELDLSGQGFSEKDLEQALAAFLSTPGGSHPALCSLNLRGTRVTPSTVSSVISSCPGLLYLNLESCRCLPRGLKRAYRGLEEVQWCLEQLLTSPSPS

SEQ ID NO: 12578 - protein, 374 aa, Homo sapiens
MAEPGEGLPEEVLALIFRHLSLRDRAAAARVCRAWAAAATCSAVWHDTKISCECELEGMLPPYLSACLDHIHNLRLEFEPSRKPSRRAAIELLMVLAGRAPGLRGLRLECRGEKPLFDAGRDVLEAVHAVCGAASQLRHLDLRRLSFTLDDALVLQAARSCPELHSLFLDNSTLVGSVGPGSVLELLEACPRLRALGLHLASLSHAILEALAAPDRAPFALLALRCACPEDARASPLPNEAWVALRRRHPGLAVELELEPALPAESVTRVLQPAVPVAALRLNLSGDTVGPVRFAAHHYAATLCALEVRAAASAELNAALEELAARCAALREVHCFCVVSHSVLDAFRAHCPRLRTYTLKLTREPHPWRPTLVA

SEQ ID NO: 12579 - protein, 163 aa, Homo sapiens
MAEPGEGLPEEVLALIFRHLSLRDRAAAARVCRAWAAAATCSAVWHDTKISCECELEGMLPPYLSACLDHIHNLRLEFEPSRKPSRRAAIELLMVLAGRAPGLRGLRLECRGEKPLFDAGRDVLEAVHAVCGAASQLRHLDLRRLSFTLDDALVLQAARSCPE

SEQ ID NO: 12580 - protein, 374 aa, Homo sapiens; identical to SEQ ID NO: 12578

SEQ ID NO: 12581 - protein, 129 aa, Homo sapiens
MAEPGEGLPEEVLALIFRHLSLRDRAAAARVCRAWAAAATCSAVWHDTKISCECELEGMLPPYLSACLDHIHNLRLEFEPSRKPSRRAAIELLMVLAGRAPGLRGLRLECRGEKPLFDAGRDVLEAVHA

SEQ ID NO: 12582 - protein, 566 aa, Homo sapiens
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 12583 - protein, 200 aa, Homo sapiens
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKAITTAAPAEQIWSNDLTISLLHSADMRPYNWSYTQFSQFNKDDSLLLASGVFLGPHNSSSGEIAVISLDSFALLSRVRNKPYD

SEQ ID NO: 12584 - protein, 267 aa, Homo sapiens
DSLSSPGLPTDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVAD

SEQ ID NO: 12585 - protein, 129 aa, Homo sapiens
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLH

SEQ ID NO: 12586 - protein, 488 aa, Homo sapiens
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRVRAPYPVVEEKNFDWPAACIALEQHLSRWAEDGRWVEYFCLAEGHVASVDSVLLLQGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRDRMETRDALMGWGGPSRGSDIPPHRPITHEAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 12587 - protein, 458 aa, Homo sapiens
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRVRAPYPVVEEKNFDWPAACIALEQHLSRWAEDGRWVEYFCLAEGHVASVDSVLLLQGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 12588 - protein, 196 aa, Homo sapiens
MRASSAVLCLSYLPDILVTGTYDKKVTIYDPRAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 12589 - protein, 155 aa, Homo sapiens
MHKNSKRNNNLRVSHTEANSVDAEKEKNESQNNFFELLPAEITFKIFSQLDIRSLCRASLTCRSWNDTIRNSDSLWKPHCMTVRAVCRREIDDDLESGYSWRVILLRNYQKSKVKHEWLSGRYSNICSPISLPEKIMYPMDADTWGEILEAELER

SEQ ID NO: 12590 - protein, 247 aa, Homo sapiens
MWPLLTMHITQLNRECLLHLFSFLDKDSRKSLARTCSQLHDVFEDPALWSLLHFRSLTELQKDNFLLGPALRSLSICWHSSRVQVCSIEDWLKSAFQRSICSRHESLVNDFLLRVCDRLSAVRSPRRREAPAPSSGTPIAVGPKSPRWGGPDHSEFADLRSGVTGARAAARRGLGSLRAERPSETPPAPGVSWGPPPPGAPVVISVKQEEGKQGRTGRRSHRAAPPCGFARTRVCPPTFPGADAFPQ

SEQ ID NO: 12591 - protein, 58 aa, Homo sapiens
NSTDPVKAAQFEMSNPSHLLFFLPCPFSPVSSLFAFVNAKLKWRLGLKTPEQTKPPGP

SEQ ID NO: 12592 - protein, 690 aa, Homo sapiens
MQPPPRKVKPAQEVKLRFLEQLSILQTWQQREADLLEDIRSYSKQRAAIEREYGQALQKLAGPFLKREGHRSGEMDSRGRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGDKALDFPGFLDMMAPRLRPMRPPPPPPAKAPDPGHPDPLT

SEQ ID NO: 12593 - protein, 684 aa, Homo sapiens
MQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 12594 - protein, 740 aa, Homo sapiens
MQPPPRKVKVTQELKNIQVEQMTKLQAKHQAECDLLEDMRTFSQKKAAIEREYAQGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 12595 - protein, 515 aa, Homo sapiens
MQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASGKD

SEQ ID NO: 12596 - protein, 617 aa, Homo sapiens
MDLKTAVFNAARDGKLRLLTKLLASKSKEEVSSLISEKTNGATPLLMAARYGHLDMVEFLLEQCSASIEVGGSVNFDGETIEGAPPLWAASAAGHLKVVQSLLNHGASVNNTTLTNSTPLRAACFDGHLEIVKYLVEHKADLEVSNRHGHTCLMISCYKGHKEIAQYLLEKGADVNRKSVKGNTALHDCAESGSLDIMKMLLMYCAKMEKDGYGMTPLLSASVTGHTNIVDFLTHHAQTSKTERINALELLGATFVDKKRDLLGALKYWKKAMNMRYSDRTNIISKPVPQTLIMAYDYAKEVNSAEELEGLIADPDEMRMQALLIRERILGPSHPDTSYYIRYRGAVYADSGNFKRCINLWKYALDMQQSNLDPLSPMTASSLLSFAELFSFMLQDRAKGLLGTTVTFDDLMGILCKSVLEIERAIKQTQCPADPLQLNKALSIILHLICLLEKVPCTLEQDHFKKQTIYRFLKLHPRGKNNFSPLHLAVDKNTTCVGRYPVCKFPSLQVTAILIECGADVNVRDSDDNSPLHIAALNNHPDIMNLLIKSGAHFDATNLHKQTASDLLDEKEIAKNLIQPINHTTLQCLAARVIVNHRIYYKGHIPEKLETFVSLHR

SEQ ID NO: 12597 - protein, 1810 aa, Homo sapiens
METLDSQRVQDRLLAAPGCSSPSGQQELFSSHVMQEESANDMECEQLPAEILRQVTVHRDPIYGFGFVAGSERPVVVRSVRPGGPSENKLLAGDQIVAINEEDVSEAPRERLIELIRSAKEFIVLTVLHTHQSPKSAFISAAKKAKLRSNPVKVRFSEQVAVGETDAKMMKKEALLLIPNVLKVFLENGQIKSFTFDGRTTVKDVMLTLQDRLSLRFIEHFALVLEYAGPEQNHKFLLLQDKQPLAYVVQRTHYHGMKCLFRISFFPKDPVELLRRDPAAFEYLYIQSRNDVIRERFGMDPKPEMLLGLAALHIYITVSATRPSQKISLKNVEKEWGLEPFLPPSLLQVIKEKNLRKSLSQQLKAHQTHPSCGTKGSAIQAKLQYLRILNELPTFTGVLFNTVGLDEKQSATTLLVGPRHGISHVIDLKTNLTTVLSEFSKISKIQLFRENQGVARVETSIMDAKPLVLLMEWPEATNFACLIAGYCRLLLDSRKMVFSRPASQPLPPPMIKADYMHSAHRPVTGGHLGKKESSYVGSVGTSPRKSSRCTPPPADSELVSFCYLHMREQRKEQESRTDVNENLIFFEETRPRTKSDPTSKSSGQGYEVVPDDFDAASLDHEPCASRARSYTLDNSLGAEALNFYCDSCKAKLQEQLGPRKGGKPGSSRDNIVDLMSLPPPGSEEEEEEEDETTSLLPAIAAPPPGFRDNSSDEDDPKRRAVQSQEQGRHLRGLLYDEIPVTLIDSVQTRTVRDHAQELDDALVSTLQALEALAASEDGPHPPPPQTAGLIVLATITPESSLDSGHETNSSELTDMSEMMSAMKQHQNTTYFLAQHLNKDSLLARKDLPFRIQSCAAQAVLTAPYSLGRPDPNPSLQPIATGQSPGPPGARRKLPQSEGQVQGERTYSLAVHPALSPQLSEQKNLSLLSPVPEDKGPGHTRAGLEMSLRAATSSLSEEQVSELRDNLPKEVRLSPKLILDPKSSVTPAIISAALQQVVHNKSLVTAGGALGNPPSRGERRLEASMGRPEVSMMSSSASKNLKFKISPSAPETSWNSQHQLGAEVSSSPRAPTGSRADSLHLSQQEDSLPVQNFPPKSYLLRTSRESVGKQATGEVAGKGGPVGGKPTLQKQGTISSQGEKAQLESTPKRSKLEETSLVPRATYPMALQSPSCQSRSHSPSCQPHGHSPSSQSRGQSPSCQPRGQSPLRSQAASRQVSTMPSRKLETTLNGAHSTSEGPAKPKSSRGPFRLRNLFSATFPTRQKKETDERQAQLQKVKQYELEFLEELLKPPSQGELPGTEYLQPPAPGRCSCQLRSSPVQQGPGMSREQRRSCDCKRICRGGRPQATQTPVPSLRGRERDRVLPSQRQPEAGPGVSLSSPINVQRIRSTSLESRECRSDPESGVSCLTTCASGGECLGAPNYRKLMRRYSISELDQGDRASLTSDVYPHPPLGMLPREAKEVEASLPIALGPKSRSLESPTLGDPSYVQVAPETKGPRQMAVFSLPEEVYRKPAELDEDSESSKCCSIRYCFYYRKCDMADDASDGKDELSYSIPMKILPGMKLDEQVVPVVSRTLQVLDAATCSSSSPEASRTQEIDLRVSTFEGSLAKINALRAHAYGLPDGFLAARLDTNELLTVLRQCVASPEARAPKPYVSQISEYKLELALKFKELRASCRRVANVDKSPTHMLAAITGSFQVLSSLIETFVRLVFIVRSEAQRQELLAKVEEVVRNYTFLLRAAEESTARNLNQQQQQQQQQQQQQQQQQQQQQQQQQQQVAAAAGAATEHPPGSPTSATVMSTFTHSLKTLIK

SEQ ID NO: 12598 - protein, 549 aa, Homo sapiens
MAVPPRGRGIDPARTNPDTFPPSGARCMEPSPERPACSQQEPTLGMDAMASEHRDVLVLLPSREQLRLAVGVKATGRELFQQVCNVASIRDAQFFGLCVVRNNEYIFMDLEQKLSKYFSKDWKKERNEGNEKPRAPFVAFLRVQHYVENGRVISDHRARHLYYCHLKERVLRSQCAHREEAYFLLAACALQADLGEHRESAHAGRYFEPHSYFPQWIITKRGIDYILRHMPTLHRERQGLSPKEAMLCFIQEACRLEDVPVHFFRLHKDKKEGRPTVILGLALRGVHIYQGKKLEIQLDGLPAAQKLVYYTGCTWRSRHLLHLLRASHQLHLRVRPTLQQLRQREEAEEKQHYRESYISDELELDLASRSFPGSGVSSQHCPHCLSRHSADSHGSSYTSGIKANSWLRESREMSVDVPLEVHGLHEKEPSSSPRTSRSHPSTRGDSQATRQEPCTQVRTRGQSAEAVHQIQEMTAGVSEEQHSHGLDDMQLHQLALHPAPTSLSHTFHRALDCRLAGPCETRATLPSKRSSNCLALDLFGEAPPQEFVV

SEQ ID NO: 12599 - protein, 481 aa, Homo sapiens
MDDVKATGRELFQQVCNVASIRDAQFFGLCVVRNNEYIFMDLEQKLSKYFSKDWKKERNEGNEKPRAPFVAFLRVQHYVENGRVISDHRARHLYYCHLKERVLRSQCAHREEAYFLLAACALQADLGEHRESAHAGRYFEPHSYFPQWIITKRGIDYILRHMPTLHRERQGLSPKEAMLCFIQEACRLEDVPVHFFRLHKDKKEGRPTVILGLALRGVHIYQGKKLEIQLDGLPAAQKLVYYTGCTWRSRHLLHLLRASHQLHLRVRPTLQQLRQREEAEEKQHYRESYISDELELDLASRSFPGSGVSSQHCPHCLSRHSADSHGSSYTSGIKANSWLRESREMSVDVPLEVHGLHEKEPSSSPRTSRSHPSTRGDSQATRQEPCTQVRTRGQSAEAVHQIQEMTAGVSEEQHSHGLDDMQLHQLALHPAPTSLSHTFHRALDCRLAGPCETRATLPSKRSSNCLALDLFGEAPPQEFVV

SEQ ID NO: 12600 - protein, 320 aa, Homo sapiens
MPTLHRERQGLSPKEAMLCFIQEACRLEDVPVHFFRLHKDKKEGRPTVILGLALRGVHIYQGKKLEIQLDGLPAAQKLVYYTGCTWRSRHLLHLLRASHQLHLRVRPTLQQLRQREEAEEKQHYRESYISDELELDLASRSFPGSGVSSQHCPHCLSRHSADSHGSSYTSGIKANSWLRESREMSVDVPLEVHGLHEKEPSSSPRTSRSHPSTRGDSQATRQEPCTQVRTRGQSAEAVHQIQEMTAGVSEEQHSHGLDDMQLHQLALHPAPTSLSHTFHRALDCRLAGPCETRATLPSKRSSNCLALDLFGEAPPQEFVV

SEQ ID NO: 12601 - protein, 464 aa, Homo sapiens
MDGTEGSAGQPGPAERSHRSSVSSVGARAADVLVYLADDTVVPLAVENLPSLSAHELHRAVREVLQLPDIALDVFALWLVSPLLEVQLKPKHQPYKLGRQWPELLLRFTSAPDDDVAMDEPFLQFRRNVFFPKRRELQIHDEEVLRLLYEEAKGNVLAARYPCDVEDCEALGALVCRVQLGPYQPGRPAACDLREKLDSFLPAHLCKRGQSLFAALRGRGARAGPGEQGLLNAYRQVQEVSSDGGCEAALGTHYRAYLLKCHELPFYGCAFFHGEVDKPAQGFLHRGGRKPVSVAISLEGVHVIDSREKHVLLGLRFQELSWDHTSPEEEEPILWLEFDGDSEGTPVNKLLKIYSKQAELMSSLIEYCIELSQAAEPAGPQDSATGSPSDPSSSLAPVQRPKLRRQGSVVSSRIQHLSTIDYVEDGKGIRRVKPKRTTSFFSRQLSLGQGSYTVVQPGDSLEQG

SEQ ID NO: 12602 - protein, 430 aa, Homo sapiens
MDGTEGSAGQPGPAERSHRSSVSSVGARAADVLVYLADDTVVPLAVENLPSLSAHELHRAVREVLQLPDIALDVFALWLVSPLLDEPFLQFRRNVFFPKRRELQIHDEEVLRLLYEEAKGNVLAARYPCDVEDCEALGALVCRVQLGPYQPGRPAACDLREKLDSFLPAHLCKRGQSLFAALRGRGARAGPGEQGLLNAYRQVQEVSSDGGCEAALGTHYRAYLLKCHELPFYGCAFFHGEVDKPAQGFLHRGGRKPVSVAISLEGVHVIDSREKHVLLGLRFQELSWDHTSPEEEEPILWLEFDGDSEGTPVNKLLKIYSKQAELMSSLIEYCIELSQAAEPAGPQDSATGSPSDPSSSLAPVQRPKLRRQGSVVSSRIQHLSTIDYVEDGKGIRRVKPKRTTSFFSRQLSLGQGSYTVVQPGDSLEQG

SEQ ID NO: 12603 - protein, 90 aa, Homo sapiens
MDGTEGSAGQPGPAERSHRSSVSSVGARAADVLVYLADDTVVPLAVENLPSLSAHELHRAVREVLQLPDIALDVFALWLVSPLLEVQLKP

SEQ ID NO: 12604 - protein, 624 aa, Homo sapiens
MAPRRLLLVGEGNFSFAAALSETLDQSTQLTATCLQRPAELARDPLAWENLQCLRERGIDVRFGVDCTQLADVFELHEREFDQIYFIFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGSLHILSGPVFQKCHILPFTMPAFHETLFILGVNQNLKDGCLQSLLDHLKGILDSLLTQTLPESSKLSSLVKFVLQSNGKDYMIRVKTHNFSPDCTEDLIIGSVITSATSVIHKDQCFVFVSMNLDLLAMLVWCISDWRMLWTFDNRFLKNFVPGKIEPFKSHSLYPPCYVHDVSFWIDQKKGFDELEFHTVARAVSQDTIISIQFLSRFQHPKTQQVSLCYRLTYQTCDKALTQQQVASMQSQFRKEIQQHLYVIPR

SEQ ID NO: 12605 - protein, 475 aa, Homo sapiens
MAALGGLILSDVYPFSCKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGSLHILSGPVFQKCHILPFTMPAFHETLFILGVNQNLKDGCLQSLLDHLKGILDSLLTQTLPESSKLSSLVKFVLQSNGKDYMIRVKTHNFSPDCTEDLIIGSVITSATSVIHKDQCFVFVSMNLDLLAMLVWCISDWRMLWTFDNRFLKNFVPGKIEPFKSHSLYPPCYVHDVSFWIDQKKGFDELEFHTVARAVSQDTIISIQFLSRFQHPKTQQVSLCYRLTYQTCDKALTQQQVASMQSQFRKEIQQHLYVIPR

SEQ ID NO: 12606 - protein, 551 aa, Homo sapiens
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 12607 - protein, 185 aa, Homo sapiens
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTAR

SEQ ID NO: 12608 - protein, 463 aa, Homo sapiens
MSGGEQKPERYYVGVDVGTGSVRAALVDQSGVLLAFADQPIKNWEPQFNHHEQSSEDIWAACCVVTKNLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 12609 - protein, 575 aa, Homo sapiens
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMRTTGYLYIPALAALHSPSSLLSPQVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 12610 - protein, 1143 aa, Homo sapiens
MHVMNCVSLVSDKENGNIATAPGFMIGQTPPPAPPPPPPPPPPSPPCSCSREECPSSPPPPPPPPLPGEPPIPPPPPGLPPTTHMNGYSHLGKKKRMRSFFWKTIPEEQVRGKTNIWTLAARQEHHYQIDTKTIEELFGQQEDTTKSSLPRRGRTLNSSFREAREEITILDAKRSMNIGIFLKQFKKSPRSIVEDIHQGKSEHYGSETLREFLKFLPESEEVKKLKAFSGDVSKLSLADSFLYGLIQVPNYSLRIEAMVLKKEFLPSCSSLYTDITVLRTAIKELMSCEELHSILHLVLQAGNIMNAGGYAGNAVGFKLSSLLKLADTKANKPGMNLLHFVAQEAQKKDTILLNFSEKLHHVQKTARLSLENTEAELHLLFVRTKSLKENIQRDGELCQQMEDFLQFAIEKLRELECWKQELQDEAYTLIDFFCEDKKTMKLDECFQIFRDFCTKFNKAVKDNHDREAQELRQLQRLKEQEQKQRSWATGELGAFGRSSSENDVELLTKKGAEGLLPFLHPRPISPSSPSYRPPNTRRSRLSLGPSADRELLTFLESSTGSPEEPNKFHSLPRSSPRQARPTIACLEPAEVRHQDSSFAHKPQASGGQEEAPNPPSAQAHQLAAAQPENHASAFPRARRQGVSVLRKRYSEPVSLGSAQSPPLSPLALGIKEHELVTGLAQFNLQGSQGMEETSQLTLSDFSPMELESVGHRGPQSLSASSSSLTPMGRDALGSLSPALEDGKAAPDEPGSAALGSVGSSDPENKDPRPLFCISDTTDCSLTLDCSEGTDSRPRGGDPEEGGEGDGSMSSGVGEMGDSQVSSNPTSSPPGEAPAPVSVDSEPSCKGGLPRDKPTKRKDVVAPKRGSLKEASPGASKPGSARRSQGAVAKSVRTLTASENESMRKVMPITKSSRGAGWRRPELSSRGPSQNPPSSTDTVWSRQNSVRRASTGAEEQRLPRGSSGSSSTRPGRDVPLQPRGSFKKPSAKPLRNLPRQKPEENKTCRAHSEGPESPKEEPKTPSVPSVPHELPRVPSFARNTVASSSRSMRTDLPPVAKAPGITRTVSQRQLRVKGDPEDAAPKDSSTLRRASSARAPKKRPESAEGPSANTEAPLKARGAGERASLRRKDSSRTTLGRILNPLRK

SEQ ID NO: 12611 - protein, 1143 aa, Homo sapiens; identical to SEQ ID NO: 12610

SEQ ID NO: 12612 - protein, 749 aa, Homo sapiens
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVSEYPPYMMKRRDPAREQRDWRLSGEAAEAEDLGFGGWGSAGQCQDLREAYRYTHGRASEEYECYVIPEEEDEEEAADVFCVTCKTPIRAFQKVFDEHKEHEVIPLNEALESAKDEIHKNMYKLEKQIIEMENFANHLEEVFITVEENFGKQEQNFESHYNEILETLAQKYEEKIQALGEKKKEKLEALYGQLVSCGENLDTCKELMETIEEMCHEEKVDFIKDAVAMADRLGKFLKTKTDVEISAQPEFEDQTLDFSDVEQLMGSINTIPAPSAPVINPQVPNSATGSSVRVCWSLYSDDTVESYQLSYRPVQDSSPGTDQAEFTVTVKETYCSVTNLVPNTQYEFWVTAHNRAGPSPSSERAVYMTAPSPPIIKTKEIRSCEEAVLICWESGNLNPVDSYTVELTQAESPEASGVTESVVGIPTCESVVQLQPGRSYIIYVRALNMGGPSVRSEPATVHTIGSYFRLNKDTCHPWLTISEDGLTAVRSERRTPARELSPSDTHFTRCVAVMGNLIPVRGHHYWEVEVDEHLDYRVGVAFADVRKQEDLGANCLSWCMRHTFASSRHKYEFLHNRTTPDIRITVPPKKIGILLDYEHSKLSFFNVDLSQHLYTFSCQLHEFVHPCFSLEKPGCLKVHNGISMPKHVTFY

SEQ ID NO: 12613 - protein, 101 aa, Homo sapiens
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVS

SEQ ID NO: 12614 - protein, 324 aa, Homo sapiens
MASEALHQVGDGEEAVLKKENFNMMNALDQLPKPFSNPKSMNRTVTTKGLPLASKGNLVNFLEDDTINLLKPLPVEDSDCSSDETSISAFSSTLLNPIKLAVTQPNSSFFAGMLEGELNKLSFSPMAKNAENEDLALGPCPCPSKSQMATRGLLDLDNPELETETSSTHSESSVVVDLPDTPFIFEHTVNNSTAVISWTYALGKQPVSFYQLLLQEVAKTQENELPEAKNRPWIFNKILGTTVKLMELKPNTCYCLSVRAANTAGVGKWCKPYKFATLATDFSSFPENYPIQITVRRKEPRQKIVSIGPEEMRRLEDLEYLFPC

SEQ ID NO: 12615 - protein, 460 aa, Homo sapiens
MFEKYPGKMEGLFRHNPYTAFPPAVPGLPPGLPPAVSFGSLQGAFQPKSTNPELPPRLGPVPSGLSQKGTQIPDHFRPPLRKPGKWCAMHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPFLGPSPPDRCAGFLEPTWLAAPPRLARPPRFYEAGEELTGPGAVAAARLYGLEPAHPLLYSRLAPPPPPAAAPGTPHLLSKTPPGALLGAPPPLVPAPRPSSPPRGPGPARADR

SEQ ID NO: 12616 - protein, 399 aa, Homo sapiens
MHVRVAYMILRHQEKMKGDSHKLDFRNDLLPCLPGPYGALPPGQELSHPASLFTATGAVHAAANPFTAAPGAHGPFLSPSTHIDPFGRPTSFASLAALSNGAFGGLGSPTFNSGAVFAQKESPGAPPAFASPPDPWGRLHRSPLTFPAWVRPPEAARTPGSDKERPVERREPSITKEEKDRDLPFSRPQLRVSPATPKARAGEEGPRPTKESVRVKEERKEEAAAAAAAAAAAAAAAAAAATGPQGLHLLFERPRPPPFLGPSPPDRCAGFLEPTWLAAPPRLARPPRFYEAGEELTGPGAVAAARLYGLEPAHPLLYSRLAPPPPPAAAPGTPHLLSKTFCTFLQGCPSQQFPSWLIKPSDWCCVPSLWPLCGERGLQGEEPGRDSQASPWEGGASRR

SEQ ID NO: 12617 - protein, 972 aa, Homo sapiens
MEAKEEEVIDGFAIASFSTLEALEKDMALKPHERKEKWERRLIKKPRESETCPPAEPSENRRPLEAGSPGQDLEPACDGARKVPLQPSKQMKVTVSKGGDRDSDDDSVLEATSSRDPLSDSSAHAVSGRGYSCDSESGPDDKASVGSEKLFAPGTDKGPALEKSEAKAGPVPKVSGLERSRELSAESFLPTASPAPHAAPCPGPPPGSRANPLVKKEPPAPHRHTPQPPPPQPRGLLPTHVPASLGAFAGHSQAAANGLHGLSRSSSAPLGLGKHVSLSPHGPGPHLSTSHLALRSQAQHQLHAAMFAAPPTLPPPPALPASSLVLPGHPADHELLRQELNTRFLVQSAERPGASLGPGALLRAEFHQHQHTHQHTHQHTHQHQHTFAPFPAGLPPTPPAAPPPFDKYAPKLDSPYFRHSSVSFFPSFPPAIPGLPTLLPHPGPFGSLQGAFQPKVSDPYRAVVKVSTCWEGPWQGRTLVPPGRPRGARDSRSLQKTWVGVAPAPLSASILSQKPGRWCAVHVQIAWQIYRHQQKIKEMQLDPHKLEVGAKLDLFGRPPAPGVFAGFHYPQDLARPLFPSTGAAHPASNPFGPSAHPGSFLPTGPLTDPFSRPSTFGGLGSLSSHAFGGLGSHALAPGGSIFAPKEGSSVHGLPSPHEAWNRLHRAPPSFPAPPPWPKSVDAERVSALTNHDREPDNGKEEQERDLLEKTRLLSRASPATPAGHPVSGLLLRAQSELGRSGAPAEREAEPRVKESRSPAKEEAAKMPARASPPHSKAAPGDVKVKEERGEDEASEPPAGGLHPAPLQLGLGRERLGAPGFAWEPFRGLELPRRAFPAAAPAPGSAALLEPPERPYRDREPHGYSPERLRGELERARAPHLPPAAPALDGALLPSLGALHFPRLSPAALHNGLLARTPPAAAALGAPPPLVTAAGPPTPPGPPRSRTTPLGGLGPGEARDYSPSRNPPEVEAR

SEQ ID NO: 12618 - protein, 1045 aa, Homo sapiens
MEAKVRPSRRSRAQRDRGRRREAARDARAQSPSSGDEPEPSPGKENAGLRGAPPRGAAPAPRTARPPRRRRRESSSQEEEVIDGFAIASFSTLEALEKDMALKPHERKEKWERRLIKKPRESETCPPAEPSENRRPLEAGSPGQDLEPACDGARKVPLQPSKQMKVTVSKGGDRDSDDDSVLEATSSRDPLSDSSAHAVSGRGYSCDSESGPDDKASVGSEKLFAPGTDKGPALEKSEAKAGPVPKVSGLERSRELSAESFLPTASPAPHAAPCPGPPPGSRANPLVKKEPPAPHRHTPQPPPPQPRGLLPTHVPASLGAFAGHSQAAANGLHGLSRSSSAPLGLGKHVSLSPHGPGPHLSTSHLALRSQAQHQLHAAMFAAPPTLPPPPALPASSLVLPGHPADHELLRQELNTRFLVQSAERPGASLGPGALLRAEFHQHQHTHQHTHQHTHQHQHTFAPFPAGLPPTPPAAPPPFDKYAPKLDSPYFRHSSVSFFPSFPPAIPGLPTLLPHPGPFGSLQGAFQPKVSDPYRAVVKVSTCWEGPWQGRTLVPPGRPRGARDSRSLQKTWVGVAPAPLSASILSQKPGRWCAVHVQIAWQIYRHQQKIKEMQLDPHKLEVGAKLDLFGRPPAPGVFAGFHYPQDLARPLFPSTGAAHPASNPFGPSAHPGSFLPTGPLTDPFSRPSTFGGLGSLSSHAFGGLGSHALAPGGSIFAPKEGSSVHGLPSPHEAWNRLHRAPPSFPAPPPWPKSVDAERVSALTNHDREPDNGKEEQERDLLEKTRLLSRASPATPAGHPVSGLLLRAQSELGRSGAPAEREAEPRVKESRSPAKEEAAKMPARASPPHSKAAPGDVKVKEERGEDEASEPPAGGLHPAPLQLGLGRERLGAPGFAWEPFRGLELPRRAFPAAAPAPGSAALLEPPERPYRDREPHGYSPERLRGELERARAPHLPPAAPALDGALLPSLGALHFPRLSPAALHNGLLARTPPAAAALGAPPPLVTAAGPPTPPGPPRSRTTPLGGLGPGEARDYSPSRNPPEVEAR

SEQ ID NO: 12619 - protein, 581 aa, Homo sapiens
MDIIKGNLDGISKPASNSRIRPGSRSSNASLEVLSTEPGSFKVDTASNLNSGKEDHSESSNTENRRTSNDDKQESCSEKIKLAEEGSDEDLDLVQHQIISECSDEPKLKELDSQLQDAIQKMKKLDKILAKKQRREKEIKKQGLEMRIKLWEEIKSAKYSEAWQSKEEMENTKKFLSLTAVSEETVGPSHEEEDTFSSVFHTQIPPEEYEMQMQKLNKDFTCDVERNESLIKSGKKPFSNTEKIELRGKHNQDFIKRNIELAKESRNPVVMVDREKKRLVELLKDLDEKDSGLSSSEGDQSGWVVPVKGYELAVTQHQQLAEIDIKLQELSAASPTISSFSPRLENRNNQKPDRDGERNMEVTPGEKILRNTKEQRDLHNRLREIDEKLKMMKENVLESTSCLSEEQLKCLLDECILKQKSIIKLSSERKKEDIEDVTPVFPQLSRSIISKLLNESETKVQKTEVEDADMLESEECEASKGYYLTKALTGHNMSEALVTEAENMKCLQFSKDVIISDTKDYFMSKTLGIGRLKRPSFLDDPLYGISVSLSSEDQHLKLSSPENTIADEQETKDAAEECKEP

SEQ ID NO: 12620 - protein, 15 aa, Homo sapiens
  MOD_RES (1)..(1): Any amino acid
XEQETKDAAEECKEP

SEQ ID NO: 12621 - protein, 2639 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 12622 - protein, 1213 aa, Homo sapiens
MRSRNQGGESASDGHISCPKPSIIGNAGEKSLSEDAKKKKKSNRKEDDVMASGTVKRHLKTSGECERKTKKSLELSKEDLIQLLSIMEGELQAREDVIHMLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKGMKAGKPVVAAPGAGNLTKFEPRAETQSMKIELKKSAASSTTSLGGGKG

SEQ ID NO: 12623 - protein, 1114 aa, Homo sapiens
MLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKGMKAGKPVVAAPGAGNLTKFEPRAETQSMKIELKKSAASSTTSLGGGKG

SEQ ID NO: 12624 - protein, 1177 aa, Homo sapiens
MRSRNQGGESASDGHISCPKPSIIGNAGEKSLSEDAKKKKKSNRKEDDVMASGTVKRHLKTSGECERKTKKSLELSKEDLIQLLSIMEGELQAREDVIHMLKTEKTKPEVLEAHYGSAEPEKVLRVLHRDAILAQEKSIGEDVYEKPISELDRLEEKQKETYRRMLEQLLLAEKCHRRTVYELENEKHKHTDYMNKSDDFTNLLEQERERLKKLLEQEKAYQARKEKENAKRLNKLRDELVKLKSFALMLVDERQMHIEQLGLQSQKVQDLTQKLREEEEKLKAITSKSKEDRQKLLKLEVDFEHKASRFSQEHEEMNAKLANQESHNRQLRLKLVGLTQRIEELEETNKNLQKAEEELQELRDKIAKGECGNSSLMAEVENLRKRVLEMEGKDEEITKTESQCRELRKKLQEEEHHSKELRLEVEKLQKRMSELEKLEEAFSKSKSECTQLHLNLEKEKNLTKDLLNELEVVKSRVKELECSESRLEKAELSLKDDLTKLKSFTVMLVDERKNMMEKIKQEERKVDGLNKNFKVEQGKVMDVTEKLIEESKKLLKLKSEMEEKVYNLTRERDELIGKLKSEEEKSSELSCSVDLLKKRLDGIEEVEREITRGRSRKGSELTCPEDNKIKELTLEIERLKKRLQQLEVVEGDLMKTEDEYDQLEQKFRTEQDKANFLSQQLEEIKHQIAKNKAIEKGEVVSQEAELRHRFRLEEAKSRDLKAEVQALKEKIHELMNKEDQLSQLQVDYSVLQQRFMEEENKNKNMGQEVLNLTKELELSKRYSRALRPSVNGRRMVDVPVTSTGVQTDAVSGEAAEEETPAVFIRKSFQEENHIMSNLRQVGLKKPVERSSVLDRYPPAANELTMRKSWIPWMRKRENGPSITQEKGPRTNSSPGHPGEVVLSPKQGQPLHIRVTPDHENSTATLEITSPTSEEFFSSTTVIPTLGNQKPRITIIPSPNVMPQKQKSGDTTLGPERAMSPVTITTFSREKTPESGRGAFADRPTSPIQIMTVSTSAAPAEIAVSPESQEMPMGRTILKVTPEKQTVPTPVRKYNSNANIITTEDNKIHIHLGSQFKRSPGTSGEGVSPVITVRPVNVTAEKEVSTGTVLRSPRNHLSSRPGASKVTSTITITPVTTSSARGTQSVSGQDGSSQRPTPTRIPMSKESIIIHQLRMNSR

SEQ ID NO: 12625 - protein, 92 aa, Homo sapiens
MGVHVETISPGDGMLEDGKKFDSSRDRNKPFKFMLGKQEVIRGWEEGVVQMSVGQRAKLTISPDYAYGATGHPGIIPPHATLVFDVELLKLE

SEQ ID NO: 12626 - protein, 108 aa, Homo sapiens
MGVHVETISPGDWRTFPKRSQTCVMHYTGMLEDGKKFDSSRDRNKPFKFMLGKQEVIRGWEEGVVQMSVGQRAKLTISPDYAYGATGHPGIIPPHATLVFDVELLKLE

SEQ ID NO: 12627 - protein, 257 aa, Homo sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYGILEEVFLLQNILVSCHRTTLHVLKCMLLVNNNTCAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 12628 - protein, 222 aa, Homo sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 12629 - protein, 221 aa, Homo sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 12630 - protein, 349 aa, Homo sapiens
METPPVNTIGEKDTSQPQQEWEKNLRENLDSVIQIRQQPRDPPTETLELEVSPDPASQILEHTQGAEKLVAELEGDSHKSHGSTSQMPETLQASDLWYCPDGSFVKKIVIRGHGLDKPKLGSCCRVLALGFPFGSGPPEGWTELTMGVGPWREETWGELIEKCLESMCQGEEAELQLPGHSGPPVRLTLASFTQGRDSWELETSEKEALAREERARGTELFRAGNPEGAARCYGRALRLLLTLPPPGPPERTVLHANLAACQLLLGQPQLAAQSCDRVLEREPGHLKALYRRGVAQAALGNLEKATADLKKVLAIDPKNRAAQEELGKVVIQGKNQDAGLAQGLRKMFG

SEQ ID NO: 12631 - protein, 140 aa, Homo sapiens
MPLPEPSEQEGESVKASQEPSPKPGTEVIPAAPRKPRKFSKLVLLTASKDSTKVAGAKRKGVHCVMSLGVPGPATLAKALLQTHPEAQRAIEAAPQEPEQKRSRQDPGTDRTEDSGLAAGPPEAAGENFAPCSVAPGKSL

SEQ ID NO: 12632 - protein, 140 aa, Homo sapiens; identical to SEQ ID NO: 12631

SEQ ID NO: 12633 - protein, 244 aa, Homo sapiens
MDMAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCLECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 12634 - protein, 287 aa, Homo sapiens
MDMAWQMMQLLLLALVTAAGSAQPRSARARTDLLNVCMNAKHHKTQPSPEDELYGQVGAPQGPSPGSVPLDDLPGAEEPEYGGDGCGGERLSPVSSPPSAVPGRRMPAARPAPARSCTRTPPACTTLTGITVVRWNPPASATLSRTAVSECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 12635 - protein, 459 aa, Homo sapiens
MTLSTEMSDASGLAEETDIDVVGEGEDEEDEEEEDDDEGGGGGPRLAVPAQRRRRRRSYAGEDELEDLEEEEDDDDILLAPPAGGSPAPPGPAPAAGAGAGGGGGGGGAGGGGSAGSGAKNPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLLPPNAAAAESLLLRGAGAAGGAGDPAAAAALFPPAPPPPPHAYGYGPYGCGYGLQLPPYAPPSALFAAAARRRRRRLPPALAPAAPATARRGRRAGPDRLRLPAAPARRRPTRPPAGLRGQGGRPGRLSAGALALLHREHHRGQLGPGRRCRRRRAGRRRRSGLALALAGGGAASSRIQRRRLRGAGGRGPGGRAHPIPRGRRGRRRLLSLLVRRLGDSAPRDCPVQCRELYC

SEQ ID NO: 12636 - protein, 733 aa, Homo sapiens
MAEVGEDSGARALLALRSAPCSPVLCAAAAAAAFPAAAPPPAPAQPQPPPGPPPPPPPPLPPGAIAGAGSSGGSSGVSGDSAVAGAAPALVAAAAASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 12637 - protein, 570 aa, Homo sapiens
MAYCLGVNFVPSRFCYQLHRLLLRCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 12638 - protein, 489 aa, Homo sapiens
MVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 12639 - protein, 583 aa, Homo sapiens
MRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPLPPPPLPPPLPLESPRSKGPGWRSPVVL

SEQ ID NO: 12640 - protein, 648 aa, Homo sapiens
MVSLPPPQSDVTLPGPTRLEGERQGDLMQAPGLPGSPAPQSKHAGFSCSSFVSDGPPERTPSLPPHSPRIASPGPEQVQGHCPAGPGPGPFRLSPSDKYPGFGFEEAAASSPGRFLKGSHAPFHPYKRPFHEDVFPEAETTLALKGHSFKTPGPLEAFEEIPVDVAEAEAFLPGFSAEAWCNGLPYPSQEHGPQVLGSEVKVKPPVLESGAGMFCYQPPLQHMYCSSQPPFHQYSPGGGSYPIPYLGSSHYQYQRMAPQASTDGHQPLFPKPIYSYSILIFMALKNSKTGSLPVSEIYNFMTEHFPYFKTAPDGWKNSVRHNLSLNKCFEKVENKSGSSSRKGCLWALNPAKIDKMQEELQKWKRKDPIAVRKSMAKPEELDSLIGDKREKLGSPLLGCPPPGLSGSGPIRPLAPPAGLSPPLHSLHPAPGPIPGKNPLQDLLMGHTPSCYGQTYLHLSPGLAPPGPPQPLFPQPDGHLELRAQPGTPQDSPLPAHTPPSHSAKLLAEPSPARTMHDTLLPDGDLGTDLDAINPSLTDFDFQGNLWEQLKDDSLALDPLVLVTSSPTSSSMPPPQPPPHCFPPGPCLTETGSGAGDLAAPGSGGSGALGDLHLTTLYSAFMELEPTPPTAPAGPSVYLSPSSKPVALA

SEQ ID NO: 12641 - protein, 396 aa, Homo sapiens
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 12642 - protein, 683 aa, Homo sapiens
MQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKRRVFVEMVKNRMQNSNSQVGTRKASLKMDQEREMLRKETSSKSSQSLLHSKPSGKY

SEQ ID NO: 12643 - protein, 1412 aa, Homo sapiens
MKAYLKSAEGFFVLNKSTTIGRHENSDLVLQSPDIDNHHALIEYNEAECSFVLQDFNSRNGTFVNECHIQNVAVKLIPGDILRFGSAGLTYELVIENPPPVSFPWMRGPAPWPGPQPPRATQQPNQAPPPSHIPFHQGVQPAPMQRSWSQAFPRPTVVLPASHRRPVSANKEMFSFVVDDARKPPVIKQVWTNAMKLSEKSVAEGIPGAVPPAEIYVEEDLAQQDKDEIILLLGKEVSRLSDYEIESKYKDVIIANLQNEVAELSQKVSETTTSRQNEKEISQKCQVLDEDIDAKQKEIQSLKSQISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKDQVQQFSGNSAVFTAGKAAGASGREGEAERGEARARGEAQSQNQATDGREGGKALEEYITQERNRAKETLEEERKRMQELESLLAQQKKALAKSITQEKNRVKEALEEEQTRVQELEERLARQKEVLESSIAHEKRKAKEALESEKRKVQDLENHLTQQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKVGTRKASLKMDQEREMLRKETSSKSSQSLLHSKPSGKY

SEQ ID NO: 12644 - protein, 1453 aa, Homo sapiens
MKAYLKSAEGFFVLNKSTTIGRHENSDLVLQSPDIDNHHALIEYNEAECSFVLQDFNSRNGTFVNECHIQNVAVKLIPGDILRFGSAGLTYELVIENPPPVSFPWMRGPAPWPGPQPPRATQQPNQAPPPSHIPFHQGVQPAPMQRSWSQAFPRPTVVLPASHRRPVSANKEMFSFVVDDARKPPVIKQVWTNAMKLSEKSVAEGIPGAVPPAEIYVEEDLAQQDKDEIILLLGKEVSRLSDYEIESKYKDVIIANLQNEVAELSQKVSETTTSRQNEKEISQKCQVLDEDIDAKQKEIQSLKSQISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKDQVQQFSGNSAVFTAGKAAGASGREGEAERGEARARGEAQSQNQATDGREGGKALEEYITQERNRAKETLEEERKRMQELESLLAQQKKALAKSITQEKNRVKEALEEEQTRVQELEERLARQKEVLESSIAHEKRKAKEALESEKRKVQDLENHLTQQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKMRKLRLRELRGAQVHTAAGKDSWDLTPDPSDPGSPAVCRVGRKCRGARTEKRKRIDTLQLCLQRERQAGPAPPACSLNG

SEQ ID NO: 12645 - protein, 316 aa, Homo sapiens
MILRPPRPCGTISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGYWDFFSHMVA

SEQ ID NO: 12646 - protein, 1376 aa, Homo sapiens
MKAYLKSAEGFFVLNKSTTIGRHENSDLVLQSPDIDNHHALIEYNEAECSFVLQDFNSRNGTFVNECHIQNVAVKLIPGDILRFGSAGLTYELVIENPPPVSFPWMRGPAPWPGPQPPRATQQPNQAPPPSHIPFHQGVQPAPMQRSWSQAFPRPTVVLPASHRRPVSANKEMFSFVVDDARKPPVIKQVWTNAMKLSEKSVAEGIPGAVPPAEIYVEEDLAQQDKDEIILLLGKEVSRLSDYEIESKYKDVIIANLQNEVAELSQKVSETTTSRQNEKEISQKCQVLDEDIDAKQKEIQSLKSQISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKDQVQQFSGNSAVFTAGKAAGASGREGEAERGEARARGEAQSQNQATDGREGGKALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKVGTRKASLKMDQEREMLRKETSSKSSQSLLHSKPSGKY

SEQ ID NO: 12647 - protein, 551 aa, Homo sapiens
MSWGTELWDQFDSLDKHTQWGIDFLERYAKFVKERIEIEQNYAKQLRNLVKKYCPKRSSKDEEPRFTSCVAFFNILNELNDYAGQREVVAEEMAHRVYGELMRYAHDLKTERKMHLQEGRKAQQYLDMCWKQMDNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGAVTYI

SEQ ID NO: 12648 - protein, 605 aa, Homo sapiens
MSWGTELWDQFDSLDKHTQWGIDFLERYAKFVKERIEIEQNYAKQLRNLVKKYCPKRSSKDEEPRFTSCVAFFNILNELNDYAGQREVVAEEMAHRVYGELMRYAHDLKTERKMHLQEGRKAQQYLDMCWKQMDNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKPQSPPLTPTSLFTSSTPNGSQFLTFSIEPVHYCMNEIKTGKPRIPSFRSLKRGWSVKMGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGS

SEQ ID NO: 12649 - protein, 604 aa, Homo sapiens
MSWGTELWDQFDSLDKHTQWGIDFLERYAKFVKERIEIEQNYAKQLRNLVKKYCPKRSSKDEEPRFTSCVAFFNILNELNDYAGQREVVAEEMAHRVYGELMRYAHDLKTERKMHLQEGRKAQQYLDMCWKQMDNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKPQSPPLTPTSLFTSSTPNGSQFLTFSIEPVHYCMNEIKTGKPRIPSFRSLKRGGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGAVTYI

SEQ ID NO: 12650 - protein, 600 aa, Homo sapiens
MSWGTELWDQFDSLDKHTQWGIDFLERYAKFVKERIEIEQNYAKQLRNLVKKYCPKRSSKDEEPRFTSCVAFFNILNELNDYAGQREVVAEEMAHRVYGELMRYAHDLKTERKMHLQEGRKAQQYLDMCWKQMDNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKPQSPPLTPTSLFTSSTPNGSQFLTFSIEPVHYCMNEIKTGKPRIPSFRSLKRGGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGS

SEQ ID NO: 12651 - protein, 418 aa, Homo sapiens
DNSKKKFERECREAEKAQQSYERLDNDTNATKADVEKAKQQLNLRTHMADENKNEYAAQLQNFNGEQHKHFYVVIPQIYKQLQEMDERRTIKLSECYRGFADSERKVIPIISKCLEGMILAAKSVDERRDSQMVVDSFKSGFEPPGDFPFEDYSQHIYRTISDGTISASKQESGKMDAKTTVGKAKGKLWLFGKKPKGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPFDGHNEGTLAMKEGEVLYIIEEDKGDGWTRARRQNGEEGYVPTSYIDVTLEKNSKGAVTYI

SEQ ID NO: 12652 - protein, 248 aa, Homo sapiens
MDAKTTVGKAKGKLWLFGKKPKPQSPPLTPTSLFTSSTPNGSQFLTFSIEPVHYCMNEIKTGKPRIPSFRSLKRGWSVKMGPALEDFSHLPPEQRRKKLQQRIDELNRELQKESDQKDALNKMKDVYEKNPQMGDPGSLQPKLAETMNNIDRLRMEIHKNEAWLSEVEGKTGGRGDRRHSSDINHLVTQGRESPEGSYTDDANQEVRGPPQQHGHHNEFDDEFEDDDPLPAIGHCKAIYPLMDIMKVL

SEQ ID NO: 12653 - protein, 1017 aa, Homo sapiens
MGKKSRAVPGRRPILQLSPPGPRGSTPGRDPEPEPDTEPDSTAAVPSQPAPSAATTTTTAVTAAAASDDSPSEDEQEAVQEVPRVVQNPPKPVMTTRPTAVKATGGLCLLGAYADSDDDDNDVSEKLAQSKETNGNQSTDIDSTLANFLAEIDAITAPQPAAPVGASAPPPTPPRPEPKEAATSTLSSSTSNGTDSTQTSGWQYDTQCSLAGVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYEINATPKGWSCHWDRDHRRYFYVNEQSGESQWEFPDGEEEEEESQAQENRDETLAKQTLKDKTGTDSNSTESSETSTGSLCKESFSGQVSSSSLMPLTPFWTLLQSNVPVLQPPLPLEMPPPPPPPPESPPPPPPPPPPAEDGEIQEVEMEDEGSEEPPAPGTEEDTPLKPSAQTTVVTSQSSVDSTISSSSSTKGIKRKATEISTAVVQRSATIGSSPVLYSQSAIATGHQAAGIGNQATGIGHQTIPVSLPAAGMGHQARGMSLQSNYLGLAAAPAIMSYAECSVPIGVTAPSLQPVQARGAVPTATIIEPPPPPPPPPPPPPPAPKMPPPEKTKKGRKDKAKKSKTKMPSLVKKWQSIQRELDEEDNSSSSEEDRESTAQKRIEEWKQQQLVSGMAERNANFEALPEDWRARLKRRKMAPNT

SEQ ID NO: 12654 - protein, 1092 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLAAVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITDLRNQPYRRADAVRRSVRRRFDDQNLRSVNGAEITM

SEQ ID NO: 12655 - protein, 568 aa, Homo sapiens
MGSEVVAGNSVGPTMGAASSGPLPPPPPPLPPSSDTPETVQNGPVTPPMPPPPPLPGPAAETVPAPPLAPPLPSAPPLPGTSSPTVVFNSGLAAVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITALKKNNITKFPNVHSRVRISSSTPVVEDTQS

SEQ ID NO: 12656 - protein, 1028 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITVLKSVPFTARTAKRGSRFFCDAAHHDESNC

SEQ ID NO: 12657 - protein, 1027 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITGLHCQPMVVRHQARSAAPPSGPPRAPGPH

SEQ ID NO: 12658 - protein, 976 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITGLHCQPMVVRHQARSAAPPSGPPRAPGPH

SEQ ID NO: 12659 - protein, 1027 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITVLKSVPFTARTAKRGSRFFCDAAHHDESNC

SEQ ID NO: 12660 - protein, 120 aa, Homo sapiens
MNGEEKSCSGYGGPDAMDGKLVSSDDDDFIVKREHTRASGIRKAVLSGPGQSAENETDQVNFREIPPRCYPKHAKACIYFTYKVHYSNSSTEIPEFLTALEVLMASDFLDIYIFLFFLFF

SEQ ID NO: 12661 - protein, 936 aa, Homo sapiens
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEGRPEFSEVVMKLEECLCNIELMSPASSNSSGSLSPSSSSDCLVNRGGPGRSHVAALRSRFELEYALNARSYAALSQSAGQYSSQGLSLEEMKRSLQYTPIDKYGYVSDPMSSMHFHSCRNSSSFEDSS

SEQ ID NO: 12662 - protein, 843 aa, Homo sapiens
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEAKSRPSHYPVSSVYTETLKKKNEDRFGMWIEYLRR

SEQ ID NO: 12663 - protein, 147 aa, Homo sapiens
MSFRFGQHLIKPSVVFLKTELSFALVNRKPVVPGHVLVCPLRPVERFHDLRPDEVADLFQTTQRVGTVVEKHFHGTSLTFSMQDGPEAGQTVKHVHVHVLPRKAGDFHRNDSIYEELQKHDKEDFPASWRSEEEMAAEAAALRVYFQ

SEQ ID NO: 12664 - protein, 309 aa, Homo sapiens
MEQLLRAELRTATLRAFGGPGAGCISEGRAYDTDAGPVFVKVNRRTQARQMFEGEVASLEALRSTGLVRVPRPMKVIDLPGGGAAFVMEHLKMKSLSSQASKLGEQMADLHLYNQKLREKLKEEENTVGRRGEGAEPQYVDKFGFHTVTCCGFIPQVNEWQDDWPTFFARHRLQAQLDLIEKDYADREARELWSRLQVKIPDLFCGLEIVPALLHGDLWSGNVAEDDVGPIIYDPASFYGHSEFELAIALMFGGFPRSFFTAYHRKIPKAPGFDQRLLLYQLFNYLNHWNHFGREYRSPSLGTMRRLLK

SEQ ID NO: 12665 - protein, 202 aa, Homo sapiens
MEQLLRAELRTATLRAFGGPGAGCISEGRAYDTDAGPVFVKVNRRTQARQMFEGEVASLEALRSTGLVRVPRPMKVIDLPGGGAAFVMEHLKMKSLSSQASKLGEQMADLHLYNQKLREKLKEEENTVGRRGEGAEPQYVDKFGFHTVTCCGFIPQEPLEPSSLKSVKFQRRLWTAQLPCASLEEANIGPYFGFVRNTAPII

SEQ ID NO: 12666 - protein, 177 aa, Homo sapiens
MQARQMFEGEVASLEALRSTGLVRVPRPMKVIDLPGGGAAFVMEHLKMKSLSSQASKLGEQMADLHLYNQKLREKLKEEENTVGRRGEGAEPQYVDKFGFHTVTCCGFIPQVNEWQDDWPTFFARHRLQAQLDLIEKDYADREARELWSRLQVGTAVTSLGKSWSSHDPAAFVRVHL

SEQ ID NO: 12667 - protein, 403 aa, Homo sapiens
MPEPLAPESYPESVCEEDVTLALKELDERCEEEEADFSGLSSQDEEEQDGFPEVQTSPLPSPFLSAIIAAFQPVAYDDEEEAWRCHVNQMLSDTDGSSAVFTFHVFSRLFQTIQRKFGEITNEAVSFLGDSLQRIGTKFKSSLEVMMLCSECPTVFVDAETLMSCGLLETLKFGVLELQEHLDTYNVKREAAEQWLDDCKRTFGAKEDMYRINTDAQELELCRRLYKLHFQLLLLFQAYCKLINQVNTIKNEAEVINMSEELAQLESILKEAESASENEEIDISKAAQTTIETAIHSLIETLKNKEFISAVAQVKAFRSLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 12668 - protein, 3013 aa, Homo sapiens
MSNITIDPDVKPGEYVIKSLFAEFAVQAEKKIEVVMAEPLEKLLSRSLQRGEDLQFDQLISSMSSVAEHCLPSLLRTLFDWYRRQNGTEDESYEYRPRSSTKSKGDEQQRERDYLLERRDLAVDFIFCLVLVEVLKQIPVHPVPDPLVHEVLNLAFKHFKHKEGYSGTNTGNVHIIADLYAEVIGVLAQSKFQAVRKKFVTELKELRQKEQSPHVVQSVISLIMGMKFFRVKMYPVEDFEASFQFMQECAQYFLEVKDKDIKHALAGLFVEILIPVAAAVKNEVNVPCLKNFVEMLYQTTFELSSRKKHSLALYPLITCLLCVSQKQFFLNNWHIFLQNCLSHLKNKDPKMSRVALESLYRLLWVYVIRIKCESNTVTQSRLMSIVSALFPKGSRSVVPRDTPLNIFVKIIQFIAQERLDFAMKEIIFDLLSVGKSTKTFTINPERMNIGLRVFLVIADSLQQKDGEPPMPTTGVILPSGNTLRVKKIFLNKTLTDEEAKVIGMSVYYPQVRKALDSILRHLDKEVGRPMCMTSVQMSNKEPEDMITGERKPKIDLFRTCIAAIPRLIPDGMSRTDLIELLARLTIHMDEELRALAFNTLQALMLDFPDWREDVLSGFVYFIVREVTDVHPTLLDNAVKMLVQLINQWKQAAQMHNKNQDTQHGVANGASHPPPLERSPYSNVFHVVEGFALVILCSSRPATRRLAVSVLREIRALFALLEIPKGDDELAIDVMDRLSPSILESFIHLTGADQTTLLYCPSSIDLQTLAEWNSSPISHQFDVISPSHIWIFAHVTQGQDPWIISLSSFLKQENLPKHCSTAVSYAWMFAYTRLQLLSPQVDINSPINAKKVNTTTSSDSYIGLWRNYLILCCSAATSSSSTSAGSVRCSPPETLASTPDSGYSIDSKIIGIPSPSSLFKHIVPMMRSESMEITESLVLGLGRTNPGAFRELIEELHPIIKEALERRPENMKRRRRRDILRVQLVRIFELLADAGVISHSASGGLDNETHFLNNTLLEYVDLTRQLLEAENEKDSDTLKDIRCHFSALVANIIQNVPVHQRRSIFPQQSLRHSLFMLFSHWAGPFSIMFTPLDRYSDRNMQINRHQYCALKAMSAVLCCGPVADNVGLSSDGYLYKWLDNILDSLDKKVHQLGCEAVTLLLELNPDQSNLMYWAVDRCYTGSGRVAAGCFKAIANVFQNRDYQCDTVMLLNLILFKAADSSRSIYEVAMQLLQILEPKMFRYAHKLEVQRTDGVLSQLSPLPHLYSVSYYQLSEELARAYPELTLAIFSEISQRIQTAHPAGRQVMLHYLLPWMNNIELVDLKPLPTARRHDEDEDDSLKDRELMVTSRRWLRGEGWGSPQATAMVLNNLMYMTAKYGDELAWSEVENVWTTLADGWPKNLKIILHFLISICGVNSEPSLLPYVKKVIVYLGRDKTMQLLEELVSELQLTDPVSSGVTHMDNPPYYRITSSYKIPSVTSGTTSSSNTMVAPTDGNPDNKPIKENIEESYVHLDIYSGLNSHLNRQHHRLESRYSSSSGGSYEEEKSDSMPLYSNWRLKVMEHNQGEPLPFPPAGGCWSPLVDYVPETSSPGLPLHRCNIAVILLTDLIIDHSVKVEWGSYLHLLLHAIFIGFDHCHPEVYEHCKRLLLHLLIVMGPNSNIRTVASVLLRNKEFNEPRVLTVKQVAHLDYNFTAGINDFIPDYQPSPMTDSGLSSSSTSSSISLGNNSAAISHLHTTILNEVDISVEQDGKVKTLMEFITSRKRGPLWNHEDVSAKNPSIKSAEQLTTFLKHVVSVFKQSSSEGIHLEHHLSEVALQTALSCSSRHYAGRSFQIFRALKQPLTATTLSDVLSRLVETVGDPGEDAQGFVIELLLTLESAIDTLAETMKHYDLLSALSQTSYHDPIMGNKYAANRKSTGQLNLSTSPINSSSYLGYNSNARSNSLRLSLIGDRRGDRRRSNTLDIMDGRINHSSSLARTRSLSSLREKGMYDVQSTTEPTNLMATIFWIAASLLESDYEYEYLLALRLLNKLLIHLPLDKSESREKIENVQSKLKWTNFPGLQQLFLKGFTSASTQEMTVHLLSKLISVSKHTLVDPSQLSGFPLNILCLLPHLIQHFDSPTQFCKETASRIAKVCAEEKCPTLVNLAHMMSLYSTHTYSRDCSNWINVVCRYLHDSFSDTTFNLVTYLAELLEKGLSSMQQSLLQIIYSLLSHIDLSAAPAKQFNLEIIKIIGKYVQSPYWKEALNILKLVVSRSASLVVPSDIPKTYGGDTGSPEISFTKIFNNVSKELPGKTLDFHFDISETPIIGNKYGDQHSAAGRNGKPKVIAVTRSTSSTSSGSNSNALVPVSWKRPQLSQRRTREKLMNVLSLCGPESGLPKNPSVVFSSNEDLEVGDQQTSLISTTEDINQEEEVAVEDNSSEQQFGVFKDFDFLDVELEDAEGESMDNFNWGVRRRSLDSIDKGDTPSLQEYQCSSSTPSLNLTNQEDTDESSEEEAALTASQILSRTQMLNSDSATDETIPDHPDLLLQSEDSTGSITTEEVLQIRDETPTLEASLDNANSRLPEDTTSVLKEEHVTTFEDEGSYIIQEQQESLVCQGILDLEETEMPEPLAPESYPESVCEEDVTLALKELDERCEEEEADFSGLSSQDEEEQDGFPEVQTSPLPSPFLSAIIAAFQPVAYDDEEEAWRCHVNQMLSDTDGSSAVFTFHVFSRLFQTIQRKFGEITNEAVSFLGDSLQRIGTKFKSSLEVMMLCSECPTVFVDAETLMSCGLLETLKFGVLELQEHLDTYNVKREAAEQWLDDCKRTFGAKEDMYRINTDAQQMEILAELELCRRLYKLHFQLLLLFQAYCKLINQVNTIKNEAEVINMSEELAQLESILKEAESASENEEIDISKAAQTTIETAIHSLIETLKNKEFISAVAQVKAFRSLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 12669 - protein, 3013 aa, Homo sapiens; identical to SEQ ID NO: 12668

SEQ ID NO: 12670 - protein, 403 aa, Homo sapiens; identical to SEQ ID NO: 12667

SEQ ID NO: 12671 - protein, 3013 aa, Homo sapiens
MSNITIDPDVKPGEYVIKSLFAEFAVQAEKKIEVVMAEPLEKLLSRSLQRGEDLQFDQLISSMSSVAEHCLPSLLRTLFDWYRRQNGTEDESYEYRPRSSTKSKGDEQQRERDYLLERRDLAVDFIFCLVLVEVLKQIPVHPVPDPLVHEVLNLAFKHFKHKEGYSGTNTGNVHIIADLYAEVIGVLAQSKFQAVRKKFVTELKELRQKEQSPHVVQSVISLIMGMKFFRVKMYPVEDFEASFQFMQECAQYFLEVKDKDIKHALAGLFVEILIPVAAAVKNEVNVPCLKNFVEMLYQTTFELSSRKKHSLALYPLITCLLCVSQKQFFLNNWHIFLQNCLSHLKNKDPKMSRVALESLYRLLWVYVIRIKCESNTVTQSRLMSIVSALFPKGSRSVVPRDTPLNIFVKIIQFIAQERLDFAMKEIIFDLLSVGKSTKTFTINPERMNIGLRVFLVIADSLQQKDGEPPMPTTGVILPSGNTLRVKKIFLNKTLTDEEAKVIGMSVYYPQVRKALDSILRHLDKEVGRPMCMTSVQMSNKEPEDMITGERKPKIDLFRTCIAAIPRLIPDGMSRTDLIELLARLTIHMDEELRALAFNTLQALMLDFPDWREDVLSGFVYFIVREVTDVHPTLLDNAVKMLVQLINQWKQAAQMHNKNQDTQHGVANGASHPPPLERSPYSNVFHVVEGFALVILCSSRPATRRLAVSVLREIRALFALLEIPKGDDELAIDVMDRLSPSILESFIHLTGADQTTLLYCPSSIDLQTLAEWNSSPISHQFDVISPSHIWIFAHVTQGQDPWIISLSSFLKQENLPKHCSTAVSYAWMFAYTRLQLLSPQVDINSPINAKKVNTTTSSDSYIGLWRNYLILCCSAATSSSSTSAGSVRCSPPETLASTPDSGYSIDSKIIGIPSPSSLFKHIVPMMRSESMEITESLVLGLGRTNPGAFRELIEELHPIIKEALERRPENMKRRRRRDILRVQLVRIFELLADAGVISHSASGGLDNETHFLNNTLLEYVDLTRQLLEAENEKDSDTLKDIRCHFSALVANIIQNVPVHQRRSIFPQQSLRHSLFMLFSHWAGPFSIMFTPLDRYSDRNMQINRHQYCALKAMSAVLCCGPVADNVGLSSDGYLYKWLDNILDSLDKKVHQLGCEAVTLLLELNPDQSNLMYWAVDRCYTGSGRVAAGCFKAIANVFQNRDYQCDTVMLLNLILFKAADSSRSIYEVAMQLLQILEPKMFRYAHKLEVQRTDGVLSQLSPLPHLYSVSYYQLSEELARAYPELTLAIFSEISQRIQTAHPAGRQVMLHYLLPWMNNIELVDLKPLPTARRHDEDEDDSLKDRELMVTSRRWLRGEGWGSPQATAMVLNNLMYMTAKYGDELAWSEVENVWTTLADGWPKNLKIILHFLISICGVNSEPSLLPYVKKVIVYLGRDKTMQLLEELVSELQLTDPVSSGVTHMDNPPYYRITSSYKIPSVTSGTTSSSNTMVAPTDGNPDNKPIKENIEESYVHLDIYSGLNSHLNRQHHRLESRYSSSSGGSYEEEKSDSMPLYSNWRLKVMEHNQGEPLPFPPAGGCWSPLVDYVPETSSPGLPLHRCNIAVILLTDLIIDHSVKVEWGSYLHLLLHAIFIGFDHCHPEVYEHCKRLLLHLLIVMGPNSNIRTVASVLLRNKEFNEPRVLTVKQVAHLDYNFTAGINDFIPDYQPSPMTDSGLSSSSTSSSISLGNNSAAISHLHTTILNEVDISVEQDGKVKTLMEFITSRKRGPLWNHEDVSAKNPSIKSAEQLTTFLKHVVSVFKQSSSEGIHLEHHLSEVALQTALSCSSRHYAGRSFQIFRALKQPLTATTLSDVLSRLVETVGDPGEDAQGFVIELLLTLESAIDTLAETMKHYDLLSALSQTSYHDPIMGNKYAANRKSTGQLNLSTSPINSSSYLGYNSNARSNSLRLSLIGDRRGDRRRSNTLDIMDGRINHSSSLARTRSLSSLREKGMYDVQSTTEPTNLMATIFWIAASLLESDYEYEYLLALRLLNKLLIHLPLDKSESREKIENVQSKLKWTNFPGLQQLFLKGFTSASTQEMTVHLLSKLISVSKHTLVDPSQLSGFPLNILCLLPHLIQHFDSPTQFCKETASRIAKVCAEEKCPTLVNLAHMMSLYSTHTYSRDCSNWINVVCRYLHDSFSDTTFNLVTYLAELLEKGLSSMQQSLLQIIYSLLSHIDLSAAPAKQFNLEIIKIIGKYVQSPYWKEALNILKLVVSRSASLVVPSDIPKTYGGDTGSPEISFTKIFNNVSKELPGKTLDFHFDISETPIIGNKYGDQHSAAGRNGKPKVIAVTRSTSSTSSGSNSNALVPVSWKRPQLSQRRTREKLMNVLSLCGPESGLPKNPSVVFSSNEDLEVGDQQTSLISTTEDINQEEEVAVEDNSSEQQFGVFKDFDFLDVELEDAEGESMDNFNWGVRRRSLDSIDKGDTPSLQEYQCSSSTPSLNLTNQEDTDESSEEEAALTASQILSRTQMLNSDSATDETIPDHPDLLLQSEDSTGSITTEEVLQIRDETPTLEASLDNANSRLPEDTTSVLKEEHVTTFEDEGSYIIQEQQESLVCQGILDLEETEMPEPLAPESYPESVCEEDVTLALKELDERCEEEEADFSGLSSQDEEEQDGFPEVQTSPLPSPFLSAIIAAFQPVAYDDEEEAWRCHVNQMLSDTDGSSAVFTFHVFSRLFQTIQRKFGEITNEAVSFLGDSLQRIGTKFKSSLEVMMLCSECPTVFVDAETLMSCGLLETLKFGVLELQEHLDTYNVKREAAEQWLDDCKRTFGAKEDMYRINTDAQLNEILVELELCRRLYKLHFQLLLLFQAYCKLINQVNTIKNEAEVINMSEELAQLESILKEAESASENEEIDISKAAQTTIETAIHSLIETLKNKEFISAVAQVKAFRSLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 12672 - protein, 182 aa, Homo sapiens
MREPIYMHSTMVFLPWELHTKKGPSPPEQFMAVKLSDSRIALKSGYGKYLGINSDELVGHSDAIGPREQWEPVFQNGKMALLASNSCFIRCNEAGDIEAKSKTAGEEEMIKIRSCAEKETKKKDDIPEEDKGNVKQCEINYVKKFQSFQDHKLKISKEESKILKKAQKDGFLHETLLDREPN

SEQ ID NO: 12673 - protein, 182 aa, Homo sapiens; identical to SEQ ID NO: 12672

SEQ ID NO: 12674 - protein, 122 aa, Homo sapiens
MDEGTYIHALDNGLFTLGAPHKEDIDEGPSPPEQFMAVKLSDSRIALKSGYGKYLGINSDELVGHSDAIGPREQWEPVFQNGKMALLASNSCFIRCNEAGDIEAKSKTAGEEEMIKMLSHHL

SEQ ID NO: 12675 - protein, 278 aa, Homo sapiens
MGKGNEDSDLHCSSIQCSTDQPPFQQISFTEKGSDEKKPFKEKGKTAFSHSSEKHIQRQGSEPNPNKENSEETKLKAGNSTAGSEPESSSYRENCRKRKMSSKDSCQDTAGNCPEKECSLSLNKKSRSSTAVHNSEIQETCDAHHRGHSRACTGHSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 12676 - protein, 282 aa, Homo sapiens
MGKGNEDPDLHCSSIQCSTDQPPFQQISFTEKGSDEKKPFKGKGKTAFSHSSEKHTQRQAGSDPNPNKENSEETKLKAGNSTAGSEPESSSYQENCRKRKISSKDICQDRAGNCPEEECNLTLNKKSRSSTAVHNSEIQETCDAHHRGSSRACTGRSKRHRSRALEVQTPSLRKSLVTSVRAMSEAVYQDLAQVWAQQIHSPLTCEQLTLLTRLRGPLCAQVQTLYSMATQAAYVFPAESWLVPATLPGPGDSALDREAHPFPGQEITEPVSGSDEAKLGAP

SEQ ID NO: 12677 - protein, 327 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 12678 - protein, 327 aa, Homo sapiens; identical to SEQ ID NO: 12677

SEQ ID NO: 12679 - protein, 136 aa, Homo sapiens
LLGERAIPRAGSQAGWRPTLGSVGGRVGSPSSAECCRPFPGQRRWNFVALQPPARRWDLTMLPRLVLNSWAQAILPPQPPKVLGLQDPGASFGSRLHPALERSPGMIYSWAVFLYPGVHPVHPRNTDLITVTKSDG

SEQ ID NO: 12680 - protein, 149 aa, Homo sapiens
MKPAGNGFPSPLAGPGSRRGCVPGLTTWIRARARETGSRRGRNVFSPERAAGSGGCFCSGRIPRVSAVDALRVAGARRAAVSRGKAGVPLRYRERHLELSEWPRKPARAHFPARTGCWWFWWLLSGGTPGTSKGGFIWLYLTWQFLLNK

SEQ ID NO: 12681 - protein, 248 aa, Homo sapiens
MGIMAASRPLSRFWEWGKNIVCVGRNYADHVREMRSAVLSEPVLFLKPSTAYAPEGSPILMPAYTRNLHHELELGVVMGKRCRAVPEAAAMDYVGGYALCLDMTARDVQDECKKKGLPWTLAKSFTASCPVSAFVPKEKIPDPHKLKLWLKVNGELRQEGETSSMIFSIPYIISYVSKIITLEEGDIILTGTPKGVGPVKENDEIEAGIHGLRQGLTLSPKLECSSAITAHCSLELPGSSNPPSASRF

SEQ ID NO: 12682 - protein, 226 aa, Homo sapiens
MGIMAASRPLSRFWEWGKNIVCVGRNYADHVREMRSAVLSEPVLFLKPSTAYAPEGSPILMPAYTRNLHHELELGVVMGKRCRAVPEAAAMDYVGGYALCLDMTARDVQDECKKKGLPWTLAKSFTASCPVSAFVPKEKIPDPHKLKLWLKVNGELRQEGETSSMIFSIPYIISYVSKIITLEEGDIILTGTPKGVGPVKENDEIEAGIHGLPKVSSATLPVRLQE

SEQ ID NO: 12683 - protein, 224 aa, Homo sapiens
MGIMAASRPLSRFWEWGKNIVCVGRNYADHVREMRSAVLSEPVLFLKPSTAYAPEGSPILMPAYTRNLHHELELGVVMGKRCRAVPEAAAMDYVGGYALCLDMTARDVQDECKKKGLPWTLAKSFTASCPVSAFVPKEKIPDPHKLKLWLKVNGELRQEGETSSMIFSIPYIISYVSKIITLEEGDIILTGTPKGVGPVKENDEIEAGIHGLVSMTFKVEKPEY

SEQ ID NO: 12684 - protein, 314 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQFVTFYPGDVILTGTPPGVGVFRKPPVFLKKGDEVQCEIEELGVIINKVV

SEQ ID NO: 12685 - protein, 127 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVP

SEQ ID NO: 12686 - protein, 81 aa, Homo sapiens
MLVSGRRRLLTVLLQAQKWPFQPSRDMRLVQFRAPHLVGPHLGLETGNGGGVINLNAFDPTLPKTMTQFLEQGEATLSVAR

SEQ ID NO: 12687 - protein, 314 aa, Homo sapiens; identical to SEQ ID NO: 12684

SEQ ID NO: 12688 - protein, 314 aa, Homo sapiens
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVLPPQSQEVDWEVELAVVIGKKGKHIKATDAMAHVAGFTVAHDVSARDWLTRRNGKQWLLGKTFDTFCPLGPALVTKDSVADPHNLKICCRVNGEVVQSSNTNQMVFKTEDLIAWVSQFVTFYPGDVILTGTPPGVGVFRKPPVFLKKGDEVQCEIEELGVIINKVV

SEQ ID NO: 12689 - protein, 314 aa, Homo sapiens; identical to SEQ ID NO: 12688

SEQ ID NO: 12690 - protein, 314 aa, Homo sapiens; identical to SEQ ID NO: 12688

SEQ ID NO: 12691 - protein, 155 aa, Homo sapiens
MATRNPPPQDYESDDDSYEVLDLTEYARRHQWWNRVFGHSSGPMVEKYSVATQIVMGGVTGWCAGFLFQKVGKLAATAVGGGFLLLQIASHSGYVQIDWKRVEKDVNKAKRQIKKRANKAAPEINNLIEEATEFIKQNIVISSGFVGGFLLGLAS

SEQ ID NO: 12692 - protein, 112 aa, Homo sapiens
MELVLVFLCSLLAPMVLASAAEKEKEMDPFHYDYQTLRIGGLVFAVVLFSVGILLILRPQEMRKPRWRTSSPPMQQSPRKQRTEVQPSGGRRQPQGGRGPVLLWQKIPLWGQ

SEQ ID NO: 12693 - protein, 112 aa, Homo sapiens; identical to SEQ ID NO: 12692

SEQ ID NO: 12694 - protein, 1178 aa, Homo sapiens
MGQDAEDTSEEPPEKEELAGVQEAETATDCPEVLEEGCEEATGVTGGEQVDLSEPPDHEKKTNQEVAAATLEDHAQDESAEESCQIVPFENDCMEDFVTSLTGSPYEFFPTESTSFCSESCSPLSESAKGLESEQAPKLGLRAEENPMVGALCGQCGSLQGGAAEGPAAPDVVVVLEEEALDDALANPYVMGVGLPGQAAPGEGGQAASDALGGYGSKEELNCEAEGGLVPADRKNTSTRVRPHSGKVAGYVPETVPEETGPEAGSSAPGIGGAAEEVGKTLLSLEGKPLEASRALPAKPRAFTLYPRSFSVEGREIPVSVYQEPEGSGLDDHRIKRKEDNLSLSCVIGSSGSFSQRNHLPSSGTSTPSSMVDIPPPFDLACITKKPITKSSPSLLIESDSPDKYKKKKSSFKRFLALTFKKKTENKLHVDVNVSSSRSSSESSYHGPSRILEVDRRSLSNSPQLKSRTGKLRASESPSSLIFYRDGKRKGVPFSRTVSRVESFEDRSRPPFLPLPLTKPRSISFPSADTSDYENIPAMNSDYENIQIPPRRPARAGAFTKLFEDQSRALSTANENDGYVDMSSFNAFESKQQSADQDAESAYTEPYKVCPISSAAPKEDLTSDEEQRSSEEEDSASRDPSVTHKVEGQSRALVIAQELLSSEKAYVEMLQHLNLDFHGAVMRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQGALSLISKVTDRANDSMEQGENLQKLVHIEHSVRGQGDLLQPGREFLKEGTLMKVTGKNRRPRHLFLMNDVLLYTYPQKDGKYRLKNTLAVANMKVSRPVMEKVPYALKIETSESCLMLSASSCAERDEWYGCLSRALPEDYKAQALAAFHHSVEIRERLGVSLGERPPTLVPVTHVMMCMNCGCDFSLTLRRHHCHACGKIVCRNCSRNKYPLKYLKDRMAKVCDGCFGELKKRGRAVPGLMRERPVSMSFPLSSPRFSGSAFSSVFQSINPSTFKKQKKVPSALTEDKVALESMPLLGFTIAPEKEEGSSEVGPIFHLYHKKTLFYSFKAEDTNSAQRWIEAMEDASVL

SEQ ID NO: 12695 - protein, 7 aa, Homo sapiens
  MOD_RES (1)..(1): Any amino acid
XEKQSQC

SEQ ID NO: 12696 - protein, 117 aa, Homo sapiens
MSWRGRSTYYWPRPRRYVQPPEMIGPMRPEQFSDEVEPATPEEGEPATQCQDPAAAQEGEDEGASAGQGPKPEAHSQEQGHPQTGCECEDGPDGQEMDPPNPEEVKTPEEGEKQSQC

SEQ ID NO: 12697 - protein, 117 aa, Homo sapiens; identical to SEQ ID NO: 12696

SEQ ID NO: 12698 - protein, 117 aa, Homo sapiens
MSWRGRSTYYWPRPRRYVQPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 12699 - protein, 117 aa, Homo sapiens; identical to SEQ ID NO: 12698

SEQ ID NO: 12700 - protein, 117 aa, Homo sapiens; identical to SEQ ID NO: 12698

SEQ ID NO: 12701 - protein, 117 aa, Homo sapiens
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEGQSQC

SEQ ID NO: 12702 - protein, 376 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMATNWTSEIPL

SEQ ID NO: 12703 - protein, 528 aa, Homo sapiens
MFGAAGRQPIGAPAAGNSWHFSRTMEELVHDLVSALEESSEQARGGFAETGDHSRSISCPLKRQARKRRGRKRRSYNVHHPWETGHCLSEGSDSSLEEPSKDYRENHNNNKKDHSDSDDQMLVAKRRPSSNLNNNVRGKRPLWHESDFAVDNVGNRTLRRRRKVKRMAVDLPQDISNKRTMTQPPEGCRDQDMDSDRAYQYQEFTKNKVKKRKLKIIRQGPKIQDEGVVLESEETNQTNKDKMECEEQKVSDELMSESDSSSLSSTDAGLFTNDEGRQGDDEQSDWFYEKESGGACGITGVVPWWEKEDPTELDKNVPDPVFESILTGSFPLMSHPSRRGFQARLSRLHGMSSKNIKKSGGTPTSMVPIPGPVGNKRMVHFSPDSHHHDHWFSPGARTEHDQHQLLRDNRAERGHKKNCSVRTASRQTSMHLGSLCTGDIKRRRKAAPLPGPTTAGFVGENAQPILENNIGNRMLQNMGWTPGSGLGRDGKGISEPIQAMQRPKGLGLGFPLPKSTSATTTPNAGKSA

SEQ ID NO: 12704 - protein, 525 aa, Homo sapiens
MAVPGEAEEEATVYLVVSGIPSVLRSAHLRSYFSQFREERGGGFLCFHYRHRPERAPPQAAPNSALIPTDPAAEGQLLSQTSATDVRPLSTRDSTPIQTRTCCCVISVRGLAQAQRLIRMYSGRRWLDSHGTWLPGRCLIRRLRLPTEASGLGSFPFKTRKELQSWKAENEAFTLADLKQLPELNPPVLMPRGNVGTPLRVFLELIRACRLPPRIITQLQLQFPKTGSSRRYGNVPFEYEDSETVEQEELVYTAEGEEIPQGTYLADIPASPCGEPEEEVGKEEEEESHSDEDDDRGEEWERHEALHEDVTGQERTTEQLFEEEIELKWEKGGSGLVFYTDAQFWQEEEGDFDEQTADDWDVDMSVYYDRDGGDKDARDSVQMRLEQRLRDGQEDGSVIERQVGTFERHTKGIGRKVMERQGWAEGQGLGCRCSGVPEALDSDGQHPRCKRGLGYHGEKLQPFGQLKRPRRNGLGLISTIYDEPLPQDQTESLLRRQPPTSMKFRTDMAFVRGSSCASDSPSLPD

SEQ ID NO: 12705 - protein, 237 aa, Homo sapiens
MPRGNVGTPLRVFLELIRACRLPPRIITQLQLQFPKTGSSRRYGNVPFEYEDSETVEQEELVYTAEGEEIPQGTYLADIPASPCGEPEEEVGKEEEEESHSDEDDDRGEEWERHEALHEDVTGQERTTEQLFEEEIELKWEKGGSGLVFYTDAQFWQEEEGDFDEQTADDWDVDMSVYYDRDGGDKDARDSVQMRLEQRLRDGQEDGSVIERQVGTFERHTKGIFTKSPLPSPPLGY

SEQ ID NO: 12706 - protein, 76 aa, Homo sapiens
  MOD_RES (1)..(1): Any amino acid
XFDEQTADDWDVDMSVYYDRDGGDKDARDSVQMRLEQRLRDGQEDGSVIERQVGTFERHTKGIFTKSPLPSPPLGY

SEQ ID NO: 12707 - protein, 128 aa, Homo sapiens
MRLEQRLRDGQEDGSVIERQVGTFERHTKGIGRKVMERQGWAEGQGLGCRCSGVPEALDSDGQHPRCKRGLGYHGEKLQPFGQLKRPRRNGLGLISTIYDEPLPQDQTESLLRRQPPTSMKFRTDMAF

SEQ ID NO: 12708 - protein, 507 aa, Homo sapiens
MAVPGEAEEEATVYLVVSGIPSVLRSAHLRSYFSQFREERGGGFLCFHYRHRPERAPPQAAPNSALIPTDPAAEGQLLSQTSATDVRPLSTRDSTPIQTRTCCCVISVRGLAQAQRLIRMYSGRRWLDSHGTWLPGRCLIRRLRLPTEASGLGSFPFKTRKELPELNPPVLMPRGNVGTPLRVFLELIRACRLPPRIITQLQLQFPKTGSSRRYGNVPFEYEDSETVEQEELVYTAEGEEIPQGTYLADIPASPCGEPEEEVGKEEEEESHSDEDDDRGEEWERHEALHEDVTGQERTTEQLFEEEIELKWEKGGSGLVFYTDAQFWQEEEGDFDEQTADDWDVDMSVYYDRDGGDKDARDSVQMRLEQRLRDGQEDGSVIERQVGTFERHTKGIGRKVMERQGWAEGQGLGCRCSGVPEALDSDGQHPRCKRGLGYHGEKLQPFGQLKRPRRNGLGLISTIYDEPLPQDQTESLLRRQPPTSMKFRTDMAFVRGSSCASDSPSLPD

SEQ ID NO: 12709 - protein, 139 aa, Homo sapiens
MDGLKVGHDPAKEFTNHWWNELFNKTAANLVVETGQDGVQIRSLSKETTRYNHPKPNLLYQKFVKVLEAVGNRVHPFSLPWFPWGLNSCLVCLINSQNFPNIVGSCDQPCCCLLRLPRPSAGIEIFRFRGSCHLLREQQ

SEQ ID NO: 12710 - protein, 445 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETLGGGTREAESRACSDGRSRKSKKKRQQHQEEEDILDVRDEKDGGAREAESRAHTGSSSRGKRKRQQHPKKERAGVSTVQKAKKKQKKRD

SEQ ID NO: 12711 - protein, 370 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETFRWWNQGSREQSMQ

SEQ ID NO: 12712 - protein, 375 aa, Homo sapiens
MFPRSGPSNDEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETFRWWNQGSREQSMQ

SEQ ID NO: 12713 - protein, 405 aa, Homo sapiens
  MOD_RES (1)..(1): Any amino acid
XSLVLGVITCAPERLNFPASACALKRAAWLLRGRGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAPPREEQPPPVLLSPSLQYAGAETLASKVQFRDPKSQRTHQAQVAFQRSLSLCPHEAAFSGATGREWGRVGARKMGASVQLLLTLISKEPINTVSEPPPRPLSRAPLSGARVPWGATRWAREIKES

SEQ ID NO: 12714 - protein, 458 aa, Homo sapiens
MSSSRPEPGPWAPLSPRLQPLSQSSSSLLGEGREQRPELRKTASSTVWQAQLGEASTRPQAPEEEGNPPESMKPARASGPKARPSAGGHWWSSTVGNVSTMGGSDLCRLRAPSAAAMQRSHSDLVRSTQMRGHSGARKASLSCSALGSSPVHRAQLQPGGTSGQGGQAPAGLERDLAPEDETSNSAWMLGASQLSVPPLDLGDTTAHSSSAQAEPKAAEQLATTTCHALPPAALLCGMREVRAGGCCHALPATGILAFPKLVASVSESGLQAQHGVKIHCRLSGGLPGHSHCCAHLWGPAGLVPEPGSRTKDVWTMTSANDLAPAEASPLSAQDAGVQAAPVAACKAVATSPSLEAPAALHVFPEVTLGSSLEEVPSPVRDVRWDAEGMTWEVYGAAVDLEVLGVAIQKHLEMQFEQLQRAPASEDSLSVEGRRGPLRAVMQSLRRPSCCGCSGAAPE

SEQ ID NO: 12715 - protein, 458 aa, Homo sapiens; identical to SEQ ID NO: 12714

SEQ ID NO: 12716 - protein, 458 aa, Homo sapiens; identical to SEQ ID NO: 12714

SEQ ID NO: 12717 - protein, 546 aa, Homo sapiens
MELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEMIESGCFKDINKSESEEALPLDLDKNIHTPVSRPNRGFFYRLFRRGGCLTMVPSEKEVEPKQC

SEQ ID NO: 12718 - protein, 500 aa, Homo sapiens
MELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEGCLTMVPSEKEVEPKQC

SEQ ID NO: 12719 - protein, 134 aa, Homo sapiens
MHGGGGVSSCSASSVSSVSQNPPAAAAPGHGAREHRGQLAAAESASSPLHPATKASVGPALQRETPTILCAILCLGPHVSLACVSRELATEPRTSSPCASHGSSSHPVTLTELLISSISLRDGAALLGLCSRTV

SEQ ID NO: 12720 - protein, 532 aa, Homo sapiens
MELENIVANSLLLKARQGGYGKKSGRSKKWKEILTLPPVSQCSELRHSIEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEGCLTMVPSEKEVEPKQC

SEQ ID NO: 12721 - protein, 313 aa, Homo sapiens
MKSPPLLSPCLSWKRMAGIFFLPFISSGFAPRFKQEENFMLGRAHPSQPRFNWSHLTPLELKNRSVGLGTESTGRGKPHFTLEGHKFLIFGGSIHYFRVPREYWRDRLLKLKACGFNTVTTYVPWNLHEPERGKFDFSGNLDLEAFVLMAAEIGLWVILRPGRYICSEMDLGGLPSWLLQDPRLLLRTTNKSFIEAVEKYFDHLIPRVIPLQYRQAGPVIAVQVENEYGSFNKDKTYMPYLHKALLRRGIVELLLTSDGEKHVLSGHTKGVLAAINLQKLHQDTFNQLHKVQGASIDAGLLSDASQAATSSSL

SEQ ID NO: 12722 - protein, 653 aa, Homo sapiens
MKSPPLLSPCLSWKRMAGIFFLPFISSGFAPRFKQEENFMLGRAHPSQPRFNWSHLTPLELKNRSVGLGTESTGRGKPHFTLEGHKFLIFGGSIHYFRVPREYWRDRLLKLKACGFNTVTTYVPWNLHEPERGKFDFSGNLDLEAFVLMAAEIGLWVILRPGRYICSEMDLGGLPSWLLQDPRLLLRTTNKSFIEAVEKYFDHLIPRVIPLQYRQAGPVIAVQVENEYGSFNKDKTYMPYLHKALLRRGIVELLLTSDGEKHVLSGHTKGVLAAINLQKLHQDTFNQLHKVQRDKPLLIMEYWVGWFDRWGDKHHVKDAKEVEHAVSEFIKYEISFNVYMFHGGTNFGFMNGATYFGKHSGIVTSYDYDAVLTEAGDYTEKYLKLQKLFQSVSATPLPRVPKLPPKAVYPPVRPSLYLPLWDALSYLNEPVRSRQPVNMENLPINNGSGQSYGLVLYEKSICSGGRLRAHAHDVAQVFLDETMIGILNENNKDLHIPELRDCRYLRILVENQGRVNFSWQIQNEQKGITGSVSINNSSLEGFTIYSLEMKMSFFERLRSATWKPVPDSHQGPAFYCGTLKAGPSPKDTFLSLLNWNYGFVFINGRNLGRYWNIGPQKTLYLPGVWLHPEDNEVILFEKMMSGSDIKSTDKPTL

SEQ ID NO: 12723 - protein, 148 aa, Homo sapiens
MEPEAFEICPYDPHHRIPLSRFQYHLASCRRKNPKKAKKMATCKYNACHVVPIKNLEEHEAVCVNRSAVEEEDTENPLKVSPPSSEQNDDTQQVSPCLPSPDIWNVDGANCQHVFVLKTFFPQKVVCENDTKESARETSPQKILRPGQ

SEQ ID NO: 12724 - protein, 123 aa, Homo sapiens
MEPEAFEICPYDPHHRIPLSRFQYHLASCRRKNPKKAKKMATCKYNACHVVPIKNLEEHEAVCVNRSAVEEEDTENPLKVSPPSSEQNDDTQQTFFPQKVVCENDTKESARETSPQKILRPGQ

SEQ ID NO: 12725 - protein, 496 aa, Homo sapiens
MDPLGAPSQFVDVDTLPSWGDSCQDELNSSDTTAEIFQEDTVRSPFLYNKDVNGKVVLWKGDVALLNCTAIVNTSNESLTDKNPVSESIFMLAGPDLKEDLQKLKGCRTGEAKLTKGFNLAARFIIHTVGPKYKSRYRTAAESSLYSCYRNVLQLAKEQSMSSVGFCVINSAKRGYPLEDATHIALRTVRRFLEIHGETIEKVVFAVSDLEEGTYQKLLPLYFPRSLKEENRSLPYLPADIGNAEGEPVVPERQIRISEKPGAPEDNQEEEDEGLGVDLSFIGSHAFARMEGDIDKQRKLILQGQLSEAALQKQHQRNYNRWLCQARSEDLSDIASLKALYQTGVDNCGRTVMVVVGRNIPVTLIDMDKALLYFIHVMDHIAVKEYVLVYFHTLTSEYNHLDSDFLKKLYDVVDVKYKRNLKAVYFVHPTFRSKVSTWFFTTFSVSGLKDKIHHVDSLHQLFSAISPEQIDFPPFVLEYDARVRSTRSSPSPGMVY

SEQ ID NO: 12726 - protein, 497 aa, Homo sapiens
MDPLGAPSQFVDVDTLPSWGDSCQDELNSSDTTAEIFQEDTVRSPFLYNKDVNGKVVLWKGDVALLNCTAIVNTSNESLTDKNPVSESIFMLAGPDLKEDLQKLKGCRTGEAKLTKGFNLAARFIIHTVGPKYKSRYRTAAESSLYSCYRNVLQLAKEQSMSSVGFCVINSAKRGYPLEDATHIALRTVRRFLEIHGETIEKVVFAVSDLEEGTYQKLLPLYFPRSLKEENRSLPYLPADIGNAEGEPVVPERQIRISEKPGAPEDNQEEEDEGLGVDLSFIGSHAFARMEGDIDKQRKLILQGQLSEAALQKQHQRNYNRWLCQARSEDLSDIASLKALYQTGVDNCGRTVMVVVGRNIPVTLIDMDKALLYFIHVMDHIAVKEYVLVYFHTLTSEYNHLDSDFLKKLYDVVDVKYKRNLKAVYFVHPTFRSKVSTWFFTTFSVSGLKDKIHHVDSLHQLFSAISPEQIDFPPFVLEYDARENGPYYTSYPPSPDL

SEQ ID NO: 12727 - protein, 127 aa, Homo sapiens
MAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVSRWNCGDWLGSEGTLPQDKADIKTQLL

SEQ ID NO: 12728 - protein, 367 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 12729 - protein, 309 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGGHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 12730 - protein, 362 aa, Homo sapiens
MATPNNLTPTNCSWWPISALESCGQASGGPRRSRGGQPHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLARTGAAVRELLDALPMDAYTHGCILHPELTTDSMIPKYATAEIRRHLANATTDLMKLDHEEEPQLSEPYLSKQKKLMAKILEHDDVSYLKKILGELAMVLDQIEGAGEEEAGERGAEMRAVALWLCLHADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 12731 - protein, 147 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGGPRLAASLELRGANPRGQLGRAQ

SEQ ID NO: 12732 - protein, 288 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGGHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASF

SEQ ID NO: 12733 - protein, 251 aa, Homo sapiens
  MOD_RES (1)..(1): Any amino acid
XSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGGCQPWGRWGLQPTQPTLPLPSLSLFFPQKSQRTSQVVKRMGYGVRLRFKS

SEQ ID NO: 12734 - protein, 123 aa, Homo sapiens
LEHDDVSYLKKILGELAMVLDQIEAELEKRKLENEGQKCELWLCGCAFTLADVLLGATLHRLKFLGLSKKYWEDGSRPNLQSFFERVQRRFAFRKVSRWNCGDWLGSEGTLPQDKADIKTQLL

SEQ ID NO: 12735 - protein, 175 aa, Homo sapiens
MKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 12736 - protein, 333 aa, Homo sapiens
PRRSRGGQPHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLARTGAAVRELLDALPMDAYTHGCILHPELTTDSMIPKYATAEIRRHLANATTDLMKLDHEEEPQLSEPYLSKQKKLMAKILEHDDVSYLKKILGELAMVLDQIEGAGEEEAGERGAEMRAVALWLCLHADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 12737 - protein, 433 aa, Homo sapiens
MGDWSFLGNILEEVNEHSTVIGRVWLTVLFIFRILILGTAAEFVWGDEQSDFVCNTQQPGCENVCYDEAFPISHIRLWVLQIIFVSTPSLMYVGHAVHYVRMEEKRKSREAEELGQQAGTNGGPDQGSVKKSSGSKGTKKFRLEGTLLRTYICHIIFKTLFEVGFIVGHYFLYGFRILPLYRCSRWPCPNVVDCFVSRPTEKTIFILFMLSVASVSLFLNVMELGHLGLKGIRSALKRPVEQPLGEIPEKSLHSIAVSSIQKAKGYQLLEEEKIVSHYFPLTEVGMVETSPLPAKPFNQFEEKISTGPLGDLSRGYQETLPSYAQVGAQEVEGEGPPAEEGAEPEVGEKKEEAERLTTEEQEKVAVPEGEKVETPGVDKEGEKEEPQSEKVSKQGLPAEKTPSLCPELTTDDARPLSRLSKASSRARSDDLTV

SEQ ID NO: 12738 - protein, 484 aa, Homo sapiens
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVLQTQKEVEVTRTHKREGSGRFSLPGATCLQGEGQGHLSQKKTVTIPSGSTLAFRVAQLVIDSDLDVLLFPDKKQRTFQPPATGHKRSTSEGAWPQLPSGLSMMRCLHNFLTDGVPAEGAFTEDFQGLRAEVETISKELELLDRELCQLLLEGLEGVLRDQLALRALEEALEQGQSLGPVEPLDGPAGAVLECLVLSSGMLVPELAIPVVYLLGALTMLSETQHKLLAEALESQTLLGPLELVGSLLEQSAPWQERSTMSLPPGLLGNSWGEGAPAWVLLDECGLELGEDTPHVCWEPQAQGRMCALYASLALLSGLSQEPH

SEQ ID NO: 12739 - protein, 114 aa, Homo sapiens
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSS

SEQ ID NO: 12740 - protein, 484 aa, Homo sapiens; identical to SEQ ID NO: 12738

SEQ ID NO: 12741 - protein, 48 aa, Homo sapiens
MGSAFERVVRRVVQELDHGGEFIPVTSLQSSTGFQPYCLVVRKPSSSW

SEQ ID NO: 12742 - protein, 164 aa, Homo sapiens
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRGDNVYVVTEVL

SEQ ID NO: 12743 - protein, 154 aa, Homo sapiens
MGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERHLRQPEHKVLQQLRSRG

SEQ ID NO: 12744 - protein, 269 aa, Homo sapiens
MPLGLKPTCSVCKTTSSSMWKKGAQGEILCHHCTGRGGAGSGGAGSGAAGGTGGSGGGGFGAATFASTSATPPQSNGGGGGKQSKQEIHRRSARLRNTKYKSAPAAEKKVSTKGKGRRHIFKLKNPIKAPESVSTIITAESIFYKGVYYQIGDVVSVIDEQDGKPYYAQIRGFIQDQYCEKSAALTWLIPTLSSPRDQFDPASYIIGPEEDLPRKMEYLEFVCHAPSEYFKSRSSPFPTVPTRPEKGYIWTHVGPTPAITIKESVANHL

SEQ ID NO: 12745 - protein, 329 aa, Homo sapiens
MELHILEHRLQVASVANESIPLFTYGLIKLAFLSSKTRCKFFSLTETPEDYTIIVDEEGFLELPSSEHLSVADATWLALNVVSGGGSFSSSQPIGVTKIAKSVIAPLADQNISVFMLSTYQTDFILVRERDLPFVTHTLSSEFTILRVVNGETVAAENLGITNGFVKPKLVQRPVIHPLSSPSNRFCVTSLDPDTLPAVATLLMDVMFYSNGVKDPMATGDDCGHIRFFSFSLIEGYISLVMDVQTQQRFPSNLLFTSASGELWKMVRIGGQPLGFDECGIVAQISEPLAAADIPAYYISTFKFDHALVPEENINGVISALKVSQAEKH

SEQ ID NO: 12746 - protein, 329 aa, Homo sapiens
MELHILEHRLQVASVAKESIPLFTYGLIKLAFLSSKTRCKFFSLTETPEDYTIIVDEEGFLELPSSEHLSVADATWLALNVVSGGGSFSSSQPIGVTKIAKSVIAPLADQNISVFMLSTYQTDFILVRERDLPFVTHTLSSEFTILRVVNGETVAAENLGITNGFVKPKLVQRPVIHPLSSPSNRFCVTSLDPDTLPAVATLLMDVMFYSNGVKDPMATGDDCGHIRFFSFSLIEGYISLVMDVQTQQRFPSNLLFTSASGELWKMVRIGGQPLGFDECGIVAQISEPLAAADIPAYYISTFKFDHALVPEENINGVISALKVSQAEKH

SEQ ID NO: 12747 - protein, 329 aa, Homo sapiens
MELHILEHRVRVLSVARPGLWLYTHPLIKLLFLPRRSRCKFFSLTETPEDYTLMVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHSTPKEAASSSPEPSSITFFAFSLIEGYISIVMDAETQKKFPSDLLLTSSSGELWRMVRIGGQPLGFDECGIVAQIAGPLAAADISAYYISTFNFDHALVPEDGIGSVIEVLQRRQEGLAS

SEQ ID NO: 12748 - protein, 163 aa, Homo sapiens
MSCRGRGAGGRWNSTSWSTGCKLPASPRRVSRCSPTGLIKLAFLFSKTRCKFFSLTETPEDYTIIVDEEGFLELPSSEHLSVADATWLALNVVSGGGSFSSSQPIGMTKIAKSVIAPLADQNISVFMLSTYQTDFILVLKRDLPFVTHTLSSEFTILWSVARL

SEQ ID NO: 12749 - protein, 387 aa, Homo sapiens
MKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLQRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVSLWAGLGGERGGECACLPDKAYPLLEVRMENVTVLGEDVIVNDELYLNGASVLPHKSIGESVPEPRIIM

SEQ ID NO: 12750 - protein, 360 aa, Homo sapiens
MKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLQRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 12751 - protein, 360 aa, Homo sapiens; identical to SEQ ID NO: 12750

SEQ ID NO: 12752 - protein, 184 aa, Homo sapiens
MDLGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWERTTPRRCLQPCIWTNWPR

SEQ ID NO: 12753 - protein, 395 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSIAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 12754 - protein, 395 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKEAVDMTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHLSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 12755 - protein, 178 aa, Homo sapiens
QYICSFEDCKKTFKKHQQLKIHQCQHTNEPLFKCTQEGCGKHFASPSKLKRHAKAHEGYVCQKGCSFVAKTWTELLKHVRETHKEESRPFVCEHAGCGKTFAMKQSLTRHAVVHDPDKKKMKLKVKKSREKRSLASHLSGYIPPKRKQGQGLSLCQNGESPNCVEDKMLSTVAVLTLG

SEQ ID NO: 12756 - protein, 365 aa, Homo sapiens
LDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQHTNEPLFKCTQEGCGKHFASPSKLKRHAKAHEGYVCQKGCSFVAKTWTELLKHVRETHKEEILCEVCRKTFKRKDYLKQHMKTHAPERDVCRCPREGCGRTYTTVFNLQSHILSFHEESRPFVCEHAGCGKTFAMKQSLTRHAVVHDPDKKKMKLKVKKSREKRSLASHLSGYIPPKRKQGQGLSLCQNGESPNCVEDKMLSTVAVLTLG

SEQ ID NO: 12757 - protein, 362 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 12758 - protein, 326 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 12759 - protein, 321 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 12760 - protein, 285 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 12761 - protein, 295 aa, Homo sapiens
MELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 12762 - protein, 340 aa, Homo sapiens
MELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHDHHQCFPRRLSSAAPTVGPLTSYHQYHNQPIHSVSEGVDFYSELRNKGFQRGASQELKEAVRSSVEEEQC

SEQ ID NO: 12763 - protein, 339 aa, Homo sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 12764 - protein, 275 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 12765 - protein, 298 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 12766 - protein, 153 aa, Homo sapiens
MSESLVVCDVAEDLVEKLRKFRFRKETNNAAIIMKIDKDKRLVVLDEELEGISPDELKDELPERQPRFIVYSYKYQHDDGRVSYPLCFIFSSPVGCKPEQQMMYAGSKNKLVQTAELTKVFEIRNTEDLTEEWLREKLFFTNVNFCVSKVFMY

SEQ ID NO: 12767 - protein, 142 aa, Homo sapiens
MSESLVVCDVAEDLVEKLRKFRFRKETNNAAIIMKIDKDKRLVVLDEELEGISPDELKDELPERQPRFIVYSYKYQHDDGRVSYPLCFIFSSPVGCKPEQQMMYAGSKNKLVQTAELTKVFEIRNTEDLTEEWLREKLGFFH

SEQ ID NO: 12768 - protein, 594 aa, Homo sapiens
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 12769 - protein, 580 aa, Homo sapiens
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 12770 - protein, 255 aa, Homo sapiens
NGKTVQVLPSALSTMFGIDSCPYYVLENHYITTPLSTEEAAFPLAYVMTISQDFDTFEWLFWAIYMPQNVYCIHVDKAATIDFKIAVSELLECFSNAFISSQSEYIIYGGKSRLQADLACMRDLIASTVQWRYVTNTGDHDFPLKTNREIVQYLKTMNWTNITPNLVSVLKSTERIKYTHREYRTRAHAFVLKKHKKKSPPPRQLKIHFGSSYVALTREFVHFALYNKIAIELLQRSQDTYSPDKHFWITLNNIP

SEQ ID NO: 12771 - protein, 391 aa, Homo sapiens
MKVWSCYLCIITLQIIIIVTVLYNVHVSQPDSGQIDDVGGEYQALSRLHICDAALNGKTVQVLPSALSTMFGIDSCPYYVLENHYITTPLSTEEAAFPLAYVMTISQDFDTFEWLFWAIYMPQNVYCIHVDKAATIDFKIAVSELLECFSNAFISSQSEYIIYGGKSRLQADLACMRDLIASTVQWRYVTNTGDHDFPLKTNREIVQYLKTMNWTNITPNLVSVLKSTERIKYTHREYRTRAHAFVLKKHKKKSPPPRQLKIHFGSSYVALTREFVHFALYNKIAIELLQRSQDTYSPDKHFWITLNNIPVECTGPWILAVNSGSCQNRHICPRGLEFQQQYPVNSFGGNNCSIAAGTAAPREALGPFHLKAACSAHQNKWGFWNCYLHLK

SEQ ID NO: 12772 - protein, 302 aa, Homo sapiens
MCLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTRLKTKGAGNGKGPLKGQPRDIYHQTWARYIVKFLDAYAEHKLQFWAVTAENEPSAGLLSGYPFQCLGFTPEHQRDFIARDLGPTLANGTHHNVRLLMLDDQRLLLPHWAKVVLTDPEAAKYVHGIAVHWYLDFLAPAKATLRETHHLFPNTMLFASEACVGSKFWEQSVRLGSWDRGMQYSHSIITNLLYHVVGWTDWNPSL

SEQ ID NO: 12773 - protein, 359 aa, Homo sapiens
MCLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTRLKTKGAGNGKGPLKGQPRDIYHQTWARYIVKFLDAYAEHKLQFWAVTAENEPSAGLLSGYPFQCLGFTPEHQRDFIARDLGPTLANGTHHNVRLLMLDDQRLLLPHWAKVVLTDPEAAKGLCGFQVLGAECAARLLGSRDAVQPQHHHKPPVPCGRLDRLEPIIVDITKHTFYKQPMFYHLGHFSKFIPEGSQRVGLVASQKNDPDAVALMHPDGSPVVVVLNRSSKDVPLTIKDPAVGFLETISPGYSIHTYLWRRQ

SEQ ID NO: 12774 - protein, 521 aa, Homo sapiens
MSSDSDRQCPVDGDIDQQEMIPSKKNAVLVDGVVLNGPTTDAKAGEKFVEEACRLIMEEVVLKATDVNEKVCEWRPPEQLKQLLDLEMRDSGEPPHKLLELCRDVIHYSVKTNHPRFFNQLYAGLDYYSLVARFMTEALNPSVYTYEVSPVFLLVEEAVLKKMIEFIGWKEGDGIFNPGGSVSNMYAMNLARYKYCPDIKEKGLSGSPRLILFTSAECHYSMKKAASFLGIGTENVCFVETDGRGKMIPEELEKQVWQARKEGAAPFLVCATSGTTVLGAFDPLDEIADICERHSLWLHVDASWGGSALMSRKHRKLLHGIHRADSVAWNPHKMLMAGIQCCALLVKDKSDLLKKCYSAKASYLFQQDKFYDVSYDTGDKSIQCSRRPDAFKFWMTWKALGTLGLEERVNRALALSRYLVDEIKKREGFKLLMEPEYANICFWYIPPSLREMEEGPEFWAKLNLVAPAIKERMMKKGSLMLGYQPHRGKVNFFRQVVISPQVSREDMDFLLDEIDLLGKDM

SEQ ID NO: 12775 - protein, 371 aa, Homo sapiens
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 12776 - protein, 443 aa, Homo sapiens
MAAHRKHVFVEKVLQRLFPPVPSGQGKREPQTLAVQNPPKKVTSEKVSQKHAEPLTDTGSETPTARRLYTASGPPEGYVPCWPEPSSCGSPENASSGDDTEDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPDHARVISAFFSYWITHILPEKSSD

SEQ ID NO: 12777 - protein, 422 aa, Homo sapiens
MAAHRKHVFVEKVLQRLFPPVPSGQGKREPQTLAVQNPPKKVTSEKVSQKHAEPLTDTGSETPTARRLYTASGPPEGYVPCWPEPSSCGSPENASSGDDTEDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPALT

SEQ ID NO: 12778 - protein, 1315 aa, Homo sapiens
MNFLSTAESRTAQAAASGTTLLPQFRAPSWQTGMHSSAATELFATGPLPSTGTLPPSLSAYQHPTTFSNRNFATTSPLVLQDSTFNTTSNGILSHHDPLLQIKTSQGTVPTALAFERLGSSVLSNSIPPQSSTYRSAQESAPHLLQPQFSLLPSALGGSQQTPQAYSSTLFTSSTASIERALLRECSVIKHHQRPSGTQSIQAQLTGSQHSLHSYLSNSSVVNFQETTRQSSLSCSPIGDSTQNLPDSSPTQNYISMHSSQNVQTQESSSPQSQKFLPAVQSSSFASSTHCQTLQNNITSPDPKSYAERKLDSDVYPSSKQEDGFPMQELQVLQPQASLESSTQRLSDGEINAQESTYKVSKADDRYSQSVIRSNSRLEDQVIGVALQASKKEESVVGSVTQLNQQIGQVNNAATLDLKNSTNLIQTPQIRLNTKDLKQQHPLILKVHESKVQEQHDQIINASSQIQIPNHALGHGHQASLPNTQVLLDSACDLQILQQSILQAGLGQVKASLQAQRVQSPQQIVHPFLQMEGHVIQSNGDHSQQQLHPQNSEVMKMDLSESSKPLQQHLTTKGHFSETNQHDSKNQFVSLGSMCFPEAVLLSDERNILSNVDDILAATAAACGVTPTDFSKSTSNETMQAVEDGDSKSHFQQSLDVRHVTSDFNSMTATVGKPQNINDTSLNGNQVTVNLSPVPALQSKMTLDQQHIETPGQNIPTKVTSAVVGPSHEVQEQSSGPFKKQSATNLESEEDSEAPVDSTLNNNRNQEFVSSSRSISGENATSESEFTLGGDDSGVSMNPARSALALLAMAQSGDAVSVKIEEENQDLMHFNLQKKRAKGKGQVKEEDNSNQKQLKRPAQGKRQNPRGTDIYLPYTPPSSESCHDGYQHQEKMRQKIKEVEEKQPEVKTGFIASFLDFLKSGPKQQFSTLAVRMPNRTRRPGTQMVRTFCPPPLPKPSSTTPTPLVSETGGNSPSDKVDNELKNLEHLSSFSSDEDDPGYSQDAYKSVSTPLTTLDATSDKKKKTEALQVATTSPTANTTGTATTSSTTVGAVKQEPLHSTSYAVNILENISSSESSKPIELDGLPSDQFAKGQDTVAIEGFTDEEDTESGGEGQYRERDEFVVKIEDIETFKEALKTGKEPPAIWKVQKALLQKFVPEIRDGQREFAATNSYLGYFGDAKSKYKRIYVKFIENANKKEYVRVCSKKPRNKPSQTIRTVQAKPSSSSKTSDPLASKTTTTKAPSVKPKVKQPKVKAEPPPKKRKKWKEEFSSSQSDSSPEIHTSSSDDEEFEPPAPFVTRFLNTRAMKETFKSYME

SEQ ID NO: 12779 - protein, 1735 aa, Homo sapiens
MNFLSTAESRTAQAAASGTTLLPQFRAPSWQTGMHSSAATELFATGPLPSTGTLPPSLSAYQHPTTFSNRNFATTSPLVLQDSTFNTTSNGILSHHDPLLQIKTSQGTVPTALAFERLGSSVLSNSIPPQSSTYRSAQESAPHLLQPQFSLLPSALGGSQQTPQAYSSTLFTSSTASIERALLRECSVIKHHQRPSGTQSIQAQLTGSQHSLHSYLSNSSVVNFQETTRQSSLSCSPIGDSTQVSNGGLQQKTSQVSVELAQSYSSAIPSSGYPPSTTKIKSCSTEQPLTSTKTPKPQSIIPPVQTLSYSKPLHNQSSVISGQAQIYSTAQLPSLLSVSQSQNYGLVQPHNVPSIVHSQVYRSSKVEKLPPLYKTLTFSGSSQTVTPENQTLNYSSNQQEVLSSVTNENYPAQTRDLSSVSQSQSYSSGHSQGLSPVSQTQVSYSSQSQVLSVVSLSESYASGESLTLTAPSLSYSSASRAQNLPDSSPTQNYISMHSSQNVQTQESSSPQSQKFLPAVQSSSFASSTHCQTLQNNITSPDPKSYAERKLDSDVYPSSKQEDGFPMQELQVLQPQASLESSTQRLSDGEINAQESTYKVSKADDRYSQSVIRSNSRLEDQVIGVALQASKKEESVVGSVTQLNQQIGQVNNAATLDLKNSTNLIQTPQIRLNTKDLKQQHPLILKVHESKVQEQHDQIINASSQIQIPNHALGHGHQASLPNTQVLLDSACDLQILQQSILQAGLGQVKASLQAQRVQSPQQIVHPFLQMEGHVIQSNGDHSQQQLHPQNSEVMKMDLSESSKPLQQHLTTKGHFSETNQHDSKNQFVSLGSMCFPEAVLLSDERNILSNVDDILAATAAACGVTPTDFSKSTSNETMQAVEDGDSKSHFQQSLDVRHVTSDFNSMTATVGKPQNINDTSLNGNQVTVNLSPVPALQSKMTLDQQHIETPGQNIPTKVTSAVVGPSHEVQEQSSGPFKKQSATNLESEEDSEAPVDSTLNNNRNQEFVSSSRSISGENATSESEFTLGGDDSGVSMNPARSALALLAMAQSGDAVSVKIEEENQDLMHFNLQKKRAKGKGQVKEEDNSNQKQLKRPAQGKRQNPRGTDIYLPYTPPSSESCHDGYQHQEKMRQKIKEVEEKQPEVKTGFIASFLDFLKSGPKQQFSTLAVRMPNRTRRPGTQMVRTFCPPPLPKPSSTTPTPLVSETGGNSPSDKVDNELKNLEHLSSFSSDEDDPGYSQDAYKSVSTPLTTLDATSDKKKKTEALQVATTSPTANTTGTATTSSTTVGAVKQEPLHSTSYAVNILENISSSESSKPIELDGLPSDQFAKGQDTVAIEGFTDEEDTESGGEGQYRERDEFVVKIEDIETFKEALKTGKEPPAIWKVQKALLQKFVPEIRDGQREFAATNSYLGYFGDAKSKYKRIYVKFIENANKKEYVRVCSKKPRNKPSQTIRTVQAKPSSSSKTSDPLASKTTTTKAPSVKPKVKQPKVKAEPPPKKRKKWKEEFSSSQSDSSPEIHTSSSDDEEFEPPAPFVTRFLNTRAMKETFKSYMELLVSIALDPDTMQALEKSNDELLLPHMKKIDGMLNDNRKRLLLNLHLDQSFKNALESFPELTIITRDSKAKSGGTAISKIKMNGKAYNKKTLRTSKTTTKSAQEFAVDPEKIQLYSLYHSLHHYKYHVYLICKDEISSVQKKNEDLGQEEIVQLCMKNVKWVEDLFEKFGELLNHVQQKCS

SEQ ID NO: 12780 - protein, 64 aa, Homo sapiens
MNFLSTAESRTAQAAASGTTLLPQFRAPSWQTGMHSSAATELFATGPLPSTGTLPPSLSAYQHP

SEQ ID NO: 12781 - protein, 1663 aa, Homo sapiens
MKDAAEELSFARVLLQRVDELEKLFKDREQFLELVSRKLSLVPGAEEVTMVTWEELEQAITDGWRASQAGSETLMGFSKHGGFTSLTSPEGTLSGDSTKQPSIEQALDSASGLGPDRTASGSGGTAHPSDGVSSREQSKVPSGTGRQQQPRARDEAGVPRLHQSSTFQFKSDSDRHRSREKLTSTQPRRNARPGPVQQDLPLARDQPSSVPASQSQVHLRPDRRGLEPTGMNQPGLVPASTYPHGVVPLSMGQLGVPPPEMDDRELIPFVVDEQRMLPPSVPGRDQQGLELPSTDQHGLVSVSAYQHGMTFPGTDQRSMEPLGMDQRGCVISGMGQQGLVPPGIDQQGLTLPVVDQHGLVLPFTDQHGLVSPGLMPISADQQGFVQPSLEATGFIQPGTEQHDLIQSGRFQRALVQRGAYQPGLVQPGADQRGLVRPGMDQSGLAQPGADQRGLVWPGMDQSGLAQPGRDQHGLIQPGTGQHDLVQSGTGQGVLVQPGVDQPGMVQPGRFQRALVQPGAYQPGLVQPGADQIDVVQPGADQHGLVQSGADQSDLAQPGAVQHGLVQPGVDQRGLAQPRADHQRGLVPPGADQRGLVQPGADQHGLVQPGVDQHGLAQPGEVQRSLVQPGIVQRGLVQPGAVQRGLVQPGAVQRGLVQPGVDQRGLVQPGAVQRGLVQPGAVQHGLVQPGADQRGLVQPGVDQRGLVQPGVDQRGLVQPGMDQRGLIQPGADQPGLVQPGAGQLGMVQPGIGQQGMVQPQADPHGLVQPGAYPLGLVQPGAYLHDLSQSGTYPRGLVQPGMDQYGLRQPGAYQPGLIAPGTKLRGSSTFQADSTGFISVRPYQHGMVPPGREQYGQVSPLLASQGLASPGIDRRSLVPPETYQQGLMHPGTDQHSPIPLSTGLGSTHPDQQHVASPGPGEHDQVYPDAAQHGHAFSLFDSHDSMYPGYRGPGYLSADQHGQEGLDPNRTRASDRHGIPAQKAPGQDVTLFRSPDSVDRVLSEGSEVSSEVLSERRNSLRRMSSSFPTAVETFHLMGELSSLYVGLKESMKDLDEEQAGQTDLEKIQFLLAQMVKRTIPPELQEQLKTVKTLAKEVWQEKAKVERLQRILEGEGNQEAGKELKAGELRLQLGVLRVTVADIEKELAELRESQDRGKAAMENSVSEASLYLQDQLDKLRMIIESMLTSSSTLLSMSMAPHKAHTLAPGQIDPEATCPACSLDVSHQVSTLVRRYEQLQDMVNSLAVSRPSKKAKLQRQDEELLGRVQSAILQVQGDCEKLNITTSNLIEDHRQKQKDIAMLYQGLEKLEKEKANREHLEMEIDVKADKSALATKVSRVQFDATTEQLNHMMQELVAKMSGQEQDWQKMLDRLLTEMDNKLDRLELDPVKQLLEDRWKSLRQQLRERPPLYQADEAAAMRRQLLAHFHCLSCDRPLETPVTGHAIPVTPAGPGLPGHHSIRPYTVFELEQVRQHSRNLKLGSAFPRGDLAQMEQSVGRLRSMHSKMLMNIEKVQIHFGGSTKASSQIIRELLHAQCLGSPCYKRVTDMADYTYSTVPRRCGGSHTLTYPYHRSRPQHLPRGLYPTEEIQIAMKHDEVDILGLDGHIYKGRMDTRLPGILRKDSSGTSKRKSQQPRPHVHRPPSLSSNGQLPSRPQSAQISAGNTSER

SEQ ID NO: 12782 - protein, 1429 aa, Homo sapiens
MKDAAEELSFARVLLQRVDELEKLFKDREQFLELVSRKLSLVPGAEEVTMVTWEELEQAITDGWRASQAGSETLMGFSKHGGFTSLTSPEGTLSGDSTKQPSIEQALDSASGLGPDRTASGSGGTAHPSDGVSSREQSKVPSGTGRQQQPRARDEAGVPRLHQSSTFQFKSDSDRHRSREKLTSTQPRRNARPGPVQQDLPLARDQPSSVPASQSQVHLRPDRRGLEPTGMNQPGLVPASTYPHGVVPLSMGQLGVPPPEMDDRELIPFVVDEQRMLPPSVPGRDQQGLELPSTDQHGLVSVSAYQHGMTFPGTDQRSMEPLGMDQRGCVISGMGQQGLVPPGIDQQGLTLPVVDQHGLVLPFTDQHGLVSPGLMPISADQQGFVQPSLEATGFIQPGTEQHDLIQSGRFQRALVQRGAYQPGLVQPGADQRGLVRPGMDQSGLAQPGADQRGLVWPGMDQSGLAQPGRDQHGLIQPGTGQHDLVQSGTGQGVLVQPGVDQPGMVQPGRFQRALVQPGAYQPGLVQPGADQIDVVQPGADQHGLVQSGADQSDLAQPGAVQHGLVQPGVDQRGLAQPRADHQRGLVPPGADQRGLVQPGADQHGLVQPGVDQHGLAQPGEVQRSLVQPGIVQRGLVQPGAVQRGLVQPGAVQRGLVQPGVDQRGLVQPGAVQRGLVQPGAVQHGLVQPGADQRGLVQPGVDQRGLVQPGVDQRGLVQPGMDQRGLIQPGADQPGLVQPGAGQLGMVQPGIGQQGMVQPQADPHGLVQPGAYPLGLVQPGAYLHDLSQSGTYPRGLVQPGMDQYGLRQPGAYQPGLIAPGTKLRGSSTFQADSTGFISVRPYQHGMVPPGREQYGQVSPLLASQGLASPGIDRRSLVPPETYQQGLMHPGTDQHSPIPLSTGLGSTHPDQQHVASPGPGEHDQVYPDAAQHGHAFSLFDSHDSMYPGYRGPGYLSADQHGQEGLDPNRTRASDRHGIPAQKAPGQDVTLFRSPDSVDRVLSEGSEVSSEVLSERRNSLRRMSSSFPTAVETFHLMGELSSLYVGLKESMKDLDEEQAGQTDLEKIQFLLAQMVKRTIPPELQEQLKTVKTLAKEVWQEKAKVERLQRILEGEGNQEAGKELKAGELRLQLGVLRVTVADIEKELAELRESQDRGKAAMENSVSEASLYLQDQLDKLRMIIESMLTSSSTLLSMSMAPHKAHTLAPGQIDPEATCPACSLDVSHQVSTLVRRYEQLQDMVNSLAVSRPSKKAKLQRQDEELLGRVQSAILQVQGDCEKLNITTSNLIEDHRQKQKDIAMLYQGLEKLEKEKANREHLEMEIDVKADKSALATKVSRVQFDATTEQLNHMMQELVAKMSGQEQDWQKMLDRLLTEMDNKLPGILRKDSSGTSKRKSQQPRPHVHRPPSLSSNGQLPSRPQSAQISAGNTSER

SEQ ID NO: 12783 - protein, 776 aa, Homo sapiens
MNNSLENTISFEEYIRVKARSVPQHRMKEFLDSLASKGPEALQEFQQTATTTMVYQQGGNCIYTDSTEVAGSLLELACPVTTSVQPQTQQEQQIQVQQPQQVQVQVQVQQSPQQVSAQLSPQLTVHQPTEQPIQVQVQIQGQAPQSAAPSIQTPSLQSPSPSQLQAAQIQVQHVQAAQQIQAAEIPEEHIPHQQIQAQLVAGQSLAGGQQIQIQTVGALSPPPSQQGSPREGERRVGTASVLQPVKKRKVDMPITVSYAISGQPVATVLAIPQGQQQSYVSLRPDLLTVDSAHLYSATGTITSPTGETWTIPVYSAQPRGDPQQQSITHIAIPQEAYNAVHVSGSPTALAAVKLEDDKEKMVGTTSVVKNSHEEVVQTLANSLFPAQFMNGNIHIPVAVQAVAGTYQNTAQTVHIWDPQQQPQQQTPQEQTPPPQQQQQQLQVTCSAQTVQVAEVEPQSQPQPSPELLLPNSLKPEEGLEVWKNWAQTKNAELEKDAQNRLAPIGRRQLLRFQEDLISSAVAELNYGLCLMTREARNGEGEPYDPDVLYYIFLCIQKYLFENGRVDDIFSDLYYVRFTEWLHEVLKDVQPRVTPLGYVLPSHVTEEMLWECKQLGAHSPSTLLTTLMFFNTKYFLLKTVDQHMKLAFSKVLRQTKKNPSNPKDKSTSIRYLKALGIHQTGQKVTDDMYAEQTENPENPLRCPIKLYDFYLFKCPQSVKGRNDTFYLTPEPVVAPNSPIWYSVQPISREQMGQMLTRILVIREIQEAIAVANASTMH

SEQ ID NO: 12784 - protein, 776 aa, Homo sapiens; identical to SEQ ID NO: 12783

SEQ ID NO: 12785 - protein, 776 aa, Homo sapiens; identical to SEQ ID NO: 12783

SEQ ID NO: 12786 - protein, 248 aa, Homo sapiens
MEDPEKKLNQKSDGKPRKVRFKISSSYSGRVLKQVFEDGQELESPKEEYPHSFLQESLETMDGVYGSGEVPRPQMCSPKLTAQRISVFREGNAYTLAGGQPRFNDYKANDHKPLPIIDFGKIIIYTNNLKIIRTPMDKRDFVRKILQKEEEAEEESLMNKEESYGGRDQHDRPLVEAESTLPQNRYTQEGDIPEDSCFHCRGSGSATCSLCHGSKFSMLANRFKESYRALRCPACNENGLQPCQICNQ

SEQ ID NO: 12787 - protein, 221 aa, Homo sapiens
  MOD_RES (73)..(73): Selenocysteine
MFQQFQASCLVLFFLVGFAQQTLKPQNRKVDCNKGVTGTIYEYGALTLNGEEYIQFKQFAGKHVLFVNVAAYCGLAAQYPELNALQEELKNFGVIVLAFPCNQFGKQEPGTNSEILLGLKYVCPGSGFVPSFQLFEKGDVNGEKEQKVFTFLKNSCPPTSDLLGSSSQLFWEPMKVHDIRWNFEKFLVGPDGVPVMHWFHQAPVSTVKSDILEYLKQFNTH

SEQ ID NO: 12788 - protein, 71 aa, Homo sapiens
LTSFRVVHTIPMIKSFFNYLSPKHLKFQVDCNKGVTGTIYEYGALTLNGEEYIQFKQFAGKHVLFVNVAAY

SEQ ID NO: 12789 - protein, 529 aa, Homo sapiens
MSGLLTDPEQRAQEPRYPGFVLGLDVGSSVIRCHVYDRAARVCGSSVQKVENLYPQIGWVEIDPDVLWIQFVAVIKEAVKAAGIQMNQIVGLGISTQRATFITWNKKTGNHFHNFISWQDLRAVELVKSWNNSLLMKIFHSSCRVLHFFTRSKRLFTASLFTFTTQQTSLRLVWILQNLTEVQKAVEEENCCFGTIDTWLLYKLTKGSVYATDFSNASTTGLFDPYKMCWSGMITSLISIPLSLLPPVRDTSHNFGSVDEEIFGVPIPIVALVADQQSAMFGECCFQTGDVKLTMGTGTFLDINTGNSLQQTTGGFYPLIGWKIGQEVVCLAESNAGDTGTAIKWAQQLDLFTDAAETEKMAKSLEDSEGVCFVPSFSGLQAPLNDPWACASFMGLKPSTSKYHLVRAILESIAFRNKQLYEMMKKEIHIPVRKIRADGGVCKNGFVMQMTSDLINENIDRPADIDMSCLGAASLAGLAVGFWTDKEELKKLRQSEVVFKPQKKCQEYEMSLENWAKAVKRSMNWYNKT

SEQ ID NO: 12790 - protein, 301 aa, Homo sapiens
MSGLLTDPEQRAQEPRYPGFVLGLDVGSSVIRCHVYDRAARVCGSSVQKVENLYPQIGWVEIDPDVLWIQFVAVIKEAVKAAGIQMNQIVGLGISTQRATFITWNKKTGNHFHNFISWQDLRAVELVKSWNNSLLMKIFHSSCRVLHFFTRSKRLFTASLFTFTTQQTSLRLVWILQNLTEVQKAVEEENCCFGTIDTWLLYKLTKGSVYATDFSNASTTGLFDPYKMCWSGMITSLISIPLSLLPPVRDTSHNFGSVDEEIFGVPIPIVALLKVPGYDQNICYIFGKGTIEPVFYHGSTL

SEQ ID NO: 12791 - protein, 119 aa, Homo sapiens
MSVTDQAFVTLATDDIYCQGALVLGQSLRRHRLTRKLVVLITPQVSSLLRDMDEAGNHDSEQTIAGIENQTLHVLTHRWELNNENTWTQGGEHHTLEPVVGRGEGGGIALGDIPNVNDE

SEQ ID NO: 12792 - protein, 96 aa, Homo sapiens
MSGSHSVTQAGVEWYNHSSLQPQTPRLKYPPTSASQVAVTTVTDQAFVTLATDDIYCQGALVLGQSLRRHRLTRKLVVLITPQVSSLLRVSLVAQA

SEQ ID NO: 12793 - protein, 64 aa, Homo sapiens
MSVTDQAFVTLATDDIYCQGALVLGQSLRRHRLTRKLVVLITPQVSSLLRPAASLVLSRVSSRP

SEQ ID NO: 12794 - protein, 63 aa, Homo sapiens
MSVTDQAFVTLATDDIYCQGALVLGQSLRRHRLTRKLVVLITPQVSSLLSLSKRCKISSSHLD

SEQ ID NO: 12795 - protein, 321 aa, Homo sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 12796 - protein, 321 aa, Homo sapiens; identical to SEQ ID NO: 12795

SEQ ID NO: 12797 - protein, 321 aa, Homo sapiens; identical to SEQ ID NO: 12795

SEQ ID NO: 12798 - protein, 321 aa, Homo sapiens; identical to SEQ ID NO: 12795

SEQ ID NO: 12799 - protein, 321 aa, Homo sapiens; identical to SEQ ID NO: 12795

SEQ ID NO: 12800 - protein, 321 aa, Homo sapiens; identical to SEQ ID NO: 12795

SEQ ID NO: 12801 - protein, 321 aa, Homo sapiens; identical to SEQ ID NO: 12795

SEQ ID NO: 12802 - protein, 321 aa, Homo sapiens; identical to SEQ ID NO: 12795

SEQ ID NO: 12803 - protein, 371 aa, Homo sapiens
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 12804 - protein, 371 aa, Homo sapiens; identical to SEQ ID NO: 12803

SEQ ID NO: 12805 - protein, 226 aa, Homo sapiens
MDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNPPPWFQCWKTIFTSVCKGCQVTHWNGHLKPWGRTASYTCLGKMVYSRPNRQIQPNPKIYRDLKHKVKQNLNCKQAFLRKSWKIACVGSNSC

SEQ ID NO: 12806 - protein, 371 aa, Homo sapiens; identical to SEQ ID NO: 12803

SEQ ID NO: 12807 - protein, 30 aa, Homo sapiens
MSFRKVNIIILVLAVALFLLVLHHNFLSLS

SEQ ID NO: 12808 - protein, 371 aa, Homo sapiens; identical to SEQ ID NO: 12803

SEQ ID NO: 12809 - protein, 174 aa, Homo sapiens
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDV

SEQ ID NO: 12810 - protein, 62 aa, Homo sapiens
MSFRKVNIIILVLAVALFLLVLHHNFLSLSSLLRNEVTDSGIVGPQPIDFVPNALRHAVDGR

SEQ ID NO: 12811 - protein, 110 aa, Homo sapiens
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLR

SEQ ID NO: 12812 - protein, 371 aa, Homo sapiens; identical to SEQ ID NO: 12803

SEQ ID NO: 12813 - protein, 89 aa, Homo sapiens
MSFRKVNIIILVLAVALFLLVLHHNFLSLSSLLRNEVTDSGIVGPQPIDFVPNALRHAVDGRQEEIPVVIAASEDRLGGAIAAINSIQH

SEQ ID NO: 12814 - protein, 63 aa, Homo sapiens
MSFRKVNIIILVLAVALFLLVLHHNFLSLSSLLRNEVTDSGIVGPQPIDFVPNALRHAVDGRQ

SEQ ID NO: 12815 - protein, 160 aa, Homo sapiens
MLRHLPSRLPVKMWGRTLEKQSWRDSSQTPPPCLIRRLDHIVMTVKSIKDTTMFYSKILGMEVMTFKEDRKALCFGDQKFNLHEVGKEFEPKAAHPVPGSLDICLITEVPLEEMIQHLKACDVPIEEGPVPRTGAKGPIMSIYFRDPDRNLIEVSNYISS

SEQ ID NO: 12816 - protein, 127 aa, Homo sapiens
  MOD_RES (1)..(1): Any amino acid
XIRRLDHIVMTVKSIKDTTMFYSKILGMEVMTFKEDRKALCFGDQKFNLHEVGKEFEPKAAHPVPGSLDICLITEVPLEEMIQHLKACDVPIEEGPVPRTGAKGPIMSIYFRDPDRNLIEVSNYISS

SEQ ID NO: 12817 - protein, 693 aa, Homo sapiens
MWPQPYLPPHPMMLEESRQNKLAAAKKKLKEYQQRKSPGIPAGAKTKKKKTDSSPETTTSGGCHSPGDSQYQELAVALESSSVTISQLNENIESLKQQKKQVEHQLEEAKKTNNEIHKAQMERLETINILTLEKADLKTTLYHTKRAARHFEEESKDLAGRLQYSLQRIQELERALCAVSTQQQEEDRSSSCREAVLQRWLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASHQNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDVFYEVSLDNNVEPAPGAAREGSPHDNPTVQQIVQLSPVMQDT

SEQ ID NO: 12818 - protein, 693 aa, Homo sapiens
MWPQPYLPPHPMMLEESRQNKLAAAKKKLKEYQQRKSPGIPAGAKTKKKKTDSSPETTTSGGGHSPGDSQYQELAVALESSSVTISQLNENIESLKQQKKQVEHQLEEAKKTNNEIHKAQMERLETINILTLEKADLKTTLYHTKRAARHFEEESKDLAGRLQYSLQRIQELERALCAVSTQQQEEDRSSSCREAVLHRRLQQTIKERALLNAHVTQVTESLKQVQLERDEYAKHIKGERARWQERMWKMSVEARTLKEEKKRDIHRIQELERSLSELKNQMAKPPSLAPPAVTSVVEQLQDEAKHLRQEVEGLEGKLQSQVENNQALSLLSKEQKQRLQEQEEMLREQEVQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASQQNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDDFYEVSLDNNVEPAPGAAREGSPHDNPTVQQIVQLSPVMQDT

SEQ ID NO: 12819 - protein, 693 aa, Homo sapiens
MWPQPYLPPHPMMLEESRQNKLAAAKKKLKEYQQRKSPGIPAGAKTKKKKTDSSPETTTSGGGHSPGDSQYQELAVALESSSVTINQLNENIESLKQQKKQVEHQLEEAKKTNNEIHKAQMEQLETINILTLEKADLKTTLYHTKRAARHFEEESKDLAGRLQYSLQRIQELERALSAVSTQQQEEDRSSSCREAVLQRRLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASQRNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDDFYEVSLDNNVEPAPGAAREGSPHDNPPVQQIVQLSPVMQDT

SEQ ID NO: 12820 - protein, 693 aa, Homo sapiens
MWPQPYLPPHPMMLEESRQNKLAAAKKKLKEYQQRKSPGIPAGAKTKKKKTDSSPETTTSGGGHSPGDSQYQELAVALESSSVTINQLNENIESLKQQKKQVEHQLEEAKKTNNEIHKAQMEQLETINILTLEKADLKTTLYHTKRAARHFEEESKDLAGRLQYSLQHIQELERALCAVSTQQQEEDRSSSCREAVLQRRLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASQRNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDVFYEVSLDNNVEPAPGVAREGSPHNNPTVQQIVQLSPVMQDT

SEQ ID NO: 12821 - protein, 668 aa, Homo sapiens
MLMWPQPHLPTHPHLPTHPHLPTHPHLPTHPHLPTHPHLPTHPHLPTHPMMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEWEEKIQEQEEKIREQEEKIREQEEKMRRQEEMMWEKEEKMRRQEEMMWEKEEKMRRLEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIREQEEIWRQKEKMHEQEKIRKQEEKVWRQEEKMHDQEEKIREQEEKMWRQEEKIREQEEKIREQEEKIREQEEMMQEQEEKMGEQEEKMQEQEKMRRQEEKIREQEEKIREQKEKIREQEEKIWEQEEKIREQEEMMQEQEEKMWEQEEKMCEQEEKMQEQEEKMRRQEEKMWEQEVRLRQQEEKMQEHQEHLEAAI

SEQ ID NO: 12822 - protein, 618 aa, Homo sapiens
MMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQLQAEADHLGKELQSVSAKLQAQVEENELWNRLNQQQEEKMWRQEEKIQEWEEKIQEQEEKIREQEEKIREQEEKMRRQEEMMWEKEEKMRRQEEMMWEKEEKMRRLEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIREQEEIWRQKEKMHEQEKIRKQEEKVWRQEEKMHDQEEKIREQEEKMWRQEEKIREQEEKIREQEEKIREQEEMMQEQEEKMGEQEEKMQEQEKMRRQEEKIREQEEKIREQKEKIREQEEKIWEQEEKIREQEEMMQEQEEKMWEQEEKMCEQEEKMQEQEEKMRRQEEKMWEQEVRLRQQEEKMQEHQEHLEAAI

SEQ ID NO: 12823 - protein, 380 aa, Homo sapiens
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLCEQEERLREQEERLREQEERLHEQEERLCEQEERLCEQEERLCEQEKLPGQERLLEEVEKLLEQERRQEEQERLLERERLWTRWRSSWSRRGFGNRMRGCGSRRLCGSWRGCGSWRGCGSWRGCGSWRGCWSWGGKPCTSSGPSHAAASRS

SEQ ID NO: 12824 - protein, 479 aa, Homo sapiens
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLCEQEERLREQEERLREQEERLHEQEERLCEQEERLCEQEERLCEQEKLPGQERLLEEVEKLLEQERRQEEQERLLERERLLDEVEELLEQERLRQQDERLWQQETLRELERLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 12825 - protein, 650 aa, Homo sapiens
MWPQPHLPPHPMMSEKTRQNKLAEAKKKFTDYRQWNIAGVGTRATDTKKKKINNGTNPETTTSEGCHSPEDTQQNRAQLKEEKKASHQHQEALRREIEAQDHTIRILTCQKTELETALYYSQDAARKFEDGNLGTPSSFNLALSQAFRGSPLGCVSTSLIPGESKDLAGRLHHSWHFAGELQRALSAVSTWHKKADRYIEELTKERDALSLELYRNTITNEELKKKNAELQEKLRLAESEKSEIQLNVKELKRKLERAKFLLPQVQTNTLQEEMWRQEEELREQEKKIRKQEEKMWRQEERLREQEGKMREQEEKMRRQEKRLREQEKELREQEKELREQKKLREQEEQMQEQEEKMWEQEEKMREQEEKMWRQEERLWEQEKQMREQEQKMRDQEERMWEQDERLREKEERMREQEKMWEQVEKMREEKKMQEQEKKTRDQEEKMQEEERIREREKKMREEEETMREQEEKMQKQEENMWEQEEKEWQQQRLPEQKEKLWEQEKMQEQEEKIWEQEEKIRDQEEMWGQEKKMWRQEKMREQEDEMREKEERIRDQKEKMQERLPEHEERCSEPCLPPSKVLCNMSHTGSVEPAGGEAGEGSPQDNPTAQEIMQLFCGMKNAQQCPGLGSTSCIPFFYRGDKRKMKIINI

SEQ ID NO: 12826 - protein, 314 aa, Homo sapiens
MWRQEEELREQEKKIRKQEEKMWRQEERLREQEGKMREQEEKMRRQEKRLREQEKELREQEKELREQKKLREQEEQMQEQEEKMWEQEEKMREQEEKMWRQEERLWEQEKQMREQEQKMRDQEERMWEQDERLREKEERMREQEKMWEQVEKMREEKKMQEQEKKTRDQEEKMQEEERIREREKKMREEEETMREQEEKMQKQEENMWEQEEKEWQQQRLPEQKEKLWEQEKMQEQEEKIWEQEEKIRDQEEMWGQEKKMWRQEKMREQEDVGAGGDAREGGEDTRSEREDAGEAARARGAVLRALPPSLQSSL

SEQ ID NO: 12827 - protein, 250 aa, Homo sapiens
MLSLLNRRQEERLREQEERLREQEERLREQEERLCEQEERLREQEERLCEQEKLPGQERLLEEVEKLLEQERRQEEQERLLERERLLEEVEKLLEQERLRQQDERLWQQETLQELERLRELERLRELERMLELGWEALYEQRAEPRSGFEELNNENKSTLQLEQQVKELKKSGGAEEPRGSESAAAARPVAGAPVPQGAWMCGQAGWTPQEHPGLSGEAVGTGEAAGGAGEAACHSFRAAENRELNITII

SEQ ID NO: 12828 - protein, 115 aa, Homo sapiens
HLRLRQQDERLWQQETLQELERLRELERLRELERMLELGWEALYEQRAEPRSGFEELNNENKSTLQLEQQVKELKKSGELKETVTSDPSKKMWEAGTSLWGGEVPGHRQLQPGDR

SEQ ID NO: 12829 - protein, 750 aa, Homo sapiens
MLMWPQPHLPTHPHLPTHPHLPTHPHLPTHPHLPTHPHLPTHPHLPTHPMMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEWEEKIQEQEEKIREQEEKIREQEEKMRRQEEMMWEKEEKMRRQEEMMWEKEEKMRRQEEMMWEKEEKMRRQEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIHEQEEIWRQKEKMHEQEEKIRKQEEKVWRQEEKIREQEEKIREQEEKMWRQEEKIREQEEMWREEEKMHEQEKIWEEEKRQEQEDKMWRQEEKIREQEEKVWRQEEKIREQEEKRQEQEEKMWKQEEKIREQEEKIQEQEEKIREQEEKIREQEEMTQEQEEKMGEQEEKMCEQEEKMQEQEETMWRQEEKIREQEKKIREQEEKIREQEEMMQEQEEKMWEQEEKMCEQEEKMQEQEEKMRRQEEKMWEQEVRLRQQEEKMQEH

SEQ ID NO: 12830 - protein, 432 aa, Homo sapiens
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPQPPAGPSKVEQLQDETNHLRKELESVGRQLQAEVENNQMLSLLNRRQEERLREQEERLREQEERLCEQEERLCEQEERLREQEERLCEQEKLPGQERLLEEVEKLLKQERRQEEQERLLERERLLDEVEELLEQERLRQQDERLWQQETLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAGEAACHSFRAAENRELNITII

SEQ ID NO: 12831 - protein, 603 aa, Homo sapiens
MAEETGQSKLAAAKKKFKEYWQRNRPGVPAAAKRNTKANGSSPETAASGGCHSSEASSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 12832 - protein, 603 aa, Homo sapiens; identical to SEQ ID NO: 12831

SEQ ID NO: 12833 - protein, 633 aa, Homo sapiens
MLPVDGEERKSEGSDTEGDRTSPCAGPTSSATLKDLEVGGSGRRCSDPAGQPSNLLPQRGLGAPLPAETAHTQPSPNDRSLYLSPKSSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 12834 - protein, 460 aa, Homo sapiens
MKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 12835 - protein, 632 aa, Homo sapiens
MAEETQHNKLAAAKKKLKEYWQKNSPRVPAGANRNRKTNGSIPQTATSGGCQPPGDSATGFHREGPTSSATLKDLESPCQERAVVLDSRSVEISQLKNTIKSLKQQKKQVEHQLEEEKKANIKKQKAKRVLEVQIQTLNIQKEELNTDLYHMKRSLRYFEEKSKDLAVRLQHSLQRKGELESVLSDVMATQKKKANQLSSPSKAGTEWKLEQSMREEALLKVQLTQLKESFQQLQLERHEYAEHLKGERARWQQRMRKMSQEICTLKKEKQQDMRRVEKLERSLSKLKNQMAEPLPPEPPAVPSEVELQHLRKELERVAGALQAQVKNNQRISLLNRGQEERIREQEERLRKQEERIQEQHKSLQQLAKPQSVFEEPNNENKSALQLEQQVKELQEKLGEEHLEAASQQNQQLTAQLSLMALPGEGHGGEHLDSEGEEAPQPMPSVPEDLESREAMSSFMDHLEEKADLSELVKKKELCFIHHWRERCHQKTHHLLSEPGGRAKDAALGGGHHQAGAQGGDEGEAAGAAADGIAAYSNYNNGHRKFLAAAHNPADEPGPGAPAPQELGAADKHGDLCEVSLTSSAQGEAREDPLLDKPTAQPIVQDHQEHPGLGSNCCVPFFCWAWLPRRRR

SEQ ID NO: 12836 - protein, 445 aa, Homo sapiens
MATQKKKANQLSSRSKARTEWKLEQSMREEALLKVQLTQFKESFQQVQLERDEYSEHLKGERARWQQRMRKMSQEICTLKKEKQQDMRRVEKLERSLSKLKNQMAEPLPPEPPAVPSEVELQHLRKELERVAGELQAQVKNNQRISLLNQRQEERIREQEERLRKQEERIQEQHKSLQQLAKPQSVFKEPNNENKNALQLEQQVKELQEKLGEEHLEAASQQNQQLTAQLSLMALPGEGHGGEHLDSEGEEAPRPMPSVPEDPESREAMSSFMDHLEEKADLSELVKKKELCFIHHWRERCHQKTHHLLSEPGGRAKDAALGGGHHQAGAQGGDEGEAAGAAADGIAAYSNYNNGHRKFLAAAHNSADEPGPGAPAPQELGAADKHGHLCEVSLTSSAQGEAREDPLLDKPTAQPIVQDHQEHPGLGSNCCVPFLCWAWLPRRRR

SEQ ID NO: 12837 - protein, 432 aa, Homo sapiens; identical to SEQ ID NO: 12830

SEQ ID NO: 12838 - protein, 631 aa, Homo sapiens
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERVLEVQIQTLIIQKEELNTDLYHMERSLRYFEEESKDLAVRLQHSLQCKGELERALSAVIATEKKKANQLSSCSKAHTEWELEQSLQDQALLKAQLTQLKESFQQLQLERDECAEHIEGERARWHQRMSKMSQEICTLKKEKQDMRWVEQLEWSLSKLKNQTAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEVASQQNQQLTAQLSLMALPGEGHGGEHLDSEGEEAPQPMPSVPEDPESREAMSSFMDHLKEKADLSELLKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 12839 - protein, 294 aa, Homo sapiens
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLICTLKKEKQDMRWVEQLEWSLSKLKNQTAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEVKETETSTPSKKGWEAGSSLLGGEVPGQRQLPAWGLVTTAPRRAVLRLFLTSCL

SEQ ID NO: 12840 - protein, 172 aa, Homo sapiens
MAGAAPTTAFGQAVIGPPGSGKTTYCLGMSEFLRALGRRVAVVNLDPANEGLPYDIFSQMAQWDLRLTAVHLVDSHYCTDPAKFISVLCTSLATMLHVELPHINLLSKMDLIEHYGKLAFNLDYYTEVLDLSYLLDHLASDPFFRHYRQLNEKLVQLIEDYSLVSFIPLNIQ

SEQ ID NO: 12841 - protein, 131 aa, Homo sapiens
MLAGLELLTSAFNLDYYTEVLDLSYLLDHLASDPFFRHYRQLNEKLVQLIEDYSLVSFIPLNIQDKESIQRVLQAVDKANGYCFRAQEQRSLEAMMSAAMGADFHFSSTLGIQEKYLAPSNQSVEQEAMQL

SEQ ID NO: 12842 - protein, 310 aa, Homo sapiens
MAGAAPTTAFGQAVIGPPGSGKTTYCLGMSEFLRALGRRVAVVNLDPANEGLPYECAVDVGELVGLGDVMDALRLGPNGGLLYCMEYLEANLDWLRAKLDPLRGHYFLFDCPGQVELCTHHGALRSIFSQMAQWDLRLTAVHLVDSHYCTDPAKFISVLCTSLATMLHVELPHINLLSKMDLIEHYGKLAFNLDYYTEVLDLSYLLDHLASDPFFRHYRQLNEKLVQLIEDYSLVSFIPLNIQDKESIQRVLQAVDKANGYCFRAQEQRSLEAMMSAAMGADFHFSSTLGIQEKYLAPSNQSVEQEAMQL

SEQ ID NO: 12843 - protein, 172 aa, Homo sapiens; identical to SEQ ID NO: 12840

SEQ ID NO: 12844 - protein, 284 aa, Homo sapiens
MPRYAQLVMGPAGSGKSTYCATMVQHCEALNRSVQVVNLDPAAEHFNYSVMADIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKFISGILAALSAMISLEIPQVNIMTKMDLLSKKAKKEIEKFLDPDMYSLLEDSTSDLRSKKFKKLTKAICGLIDDYSMVRFLPYDQSDEESMNIVLQHIDFAIQYGEDLEFKEPKEREDESSSMFDEYFQECQDE

SEQ ID NO: 12845 - protein, 294 aa, Homo sapiens
MPRYAQLVMGPAGSGKVRICGDKERKSTYCATMVQHCEALNRSVQVVNLDPAAEHFNYSVMADIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKFISGILAALSAMISLEIPQVNIMTKMDLLSKKAKKEIEKFLDPDMYSLLEDSTSDLRSKKFKKLTKAICGLIDDYSMVRFLPYDQSDEESMNIVLQHIDFAIQYGEDLEFKEPKEREDESSSMFDEYFQECQDE

SEQ ID NO: 12846 - protein, 323 aa, Homo sapiens
MLPKTRGAFHFSIPDPQHICKSRGSPYRSNVCTQTTDRSTWRKDAELYLLSVITQSTYCATMVQHCEALNRSVQVVNLDPAAEHFNYSVMADIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKFISGILAALSAMISLEIPQVNIMTKMDLLSKKAKKEIEKFLDPDMYSLLEDSTSDLRSKKFKKLTKAICGLIDDYSMVRFLPYDQSDEESMNIVLQHIDFAIQYGEDLEFKEPKEREDESSSMFDEYFQECQDE

SEQ ID NO: 12847 - protein, 776 aa, Homo sapiens
MGTVPDPLRSAKTSLIAASGKEDDLGEPQAASPRHRPALLCKNANGFSGAPAEPDLSPRAAAEALMQVCEHETTQPDMSSPGVFNEVQKAPATFNSPGNPQLPGSSQPAASAPSSAAGRDLIHTPLTMPANQHTCQSIPGDQPNAITSSMPEDSLMRSQRTSNREQPEKPSCPVGGVLSSSKDQVSCEFPSPETIQGTVQTPVTAARVVSHSSSPVGGPEGERQGAICDSEMRSCKPLTRESGCSENKQPSVTASGPQGTTSVTPQPTPLTSEPSACPPGPEKVPLPAQRQMSRFKEASTMTNQAESEIKEVPSRAWQDAEVQAVASVESRSVSTSPSILTAFLKESRAPEHFEQEQLRVICHSSGSHTLELSDSTLAPQESSQCPGIMPQVHIQAAAAESTAFQRENKLASLPGGVLKTSSINLVSSNAQHTCKEDGRLAGMTPVREESTAKKLAGTNSSSLKATAIDQISISACSQAETSYGLGKFETRPSEFAEKTTNGHKTDPDCKLSDSCGSISKADHSGSLDPTNKGDAREKKPASPQVVKEKESTGTDTSDAKTLLLNPKSQESGGTESAANPTPSPIRKNQESTLEENRQTKTATSLSLPSDPMGDSSPGSGKKTPSRSVKASPRRPSRVSEFLKEQKLNVTAAAAQVGLTPGDKKKQLGADSKLQLKQSKRVRDVVWDEQGMTWEVYGASLDAESLGIAIQNHLQRQIREHEKLIKTQNSQTRRSISSDTSSNKKLRGRQHSVFQSMLQNFRRPNCCVRPAPSSVLD

SEQ ID NO: 12848 - protein, 432 aa, Homo sapiens
MTELQQDVEDTKPAKVLGKRESKLGSAHSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 12849 - protein, 440 aa, Homo sapiens
MWKTQSLRKCSGRGRANLAQPTQRLRMVWRRKRKPAGRQQPNPLPHLWRRTPQTRRKSLAYAHIFSPNLCFIQDQESKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 12850 - protein, 371 aa, Homo sapiens
MTELQQDVEDTKPAKVLGKRESKLGSAHSEAENGVEEKKKACRSPTAQSPTPSVEADSPDQKKIISLCPYLLSKSMLHSGPRYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRVDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQHHLA

SEQ ID NO: 12851 - protein, 292 aa, Homo sapiens
MSKVKRFPFFFSSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSIFLYSMQLLSVH

SEQ ID NO: 12852 - protein, 328 aa, Homo sapiens
MYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 12853 - protein, 416 aa, Homo sapiens
MSKVKRFPFFFSSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 12854 - protein, 447 aa, Homo sapiens
MTRRQQVLQAKRSIQQTFQAQLMPWKSMFHGREVKPVGPDLELSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 12855 - protein, 586 aa, Homo sapiens
MSAGDAVCTGWLVKSPPERKLQRYAWRKRWFVLRRGRMSGNPDVLEYYRNKHSSKPIRVIDLSECAVWKHVGPSFVRKEFQNNFVFIVKTTSRTFYLVAKTEQEMQVWVHSISQVCNLGHLEDGADSMESLSYTPSSLQPSSASSLLTAHAASSSLPRDDPNTNAVATEETRSESELLFLPDYLVLSNCETGRLHHTSLPTRCDSWSNSDRSLEQASFDDVFVDCLQPLPSSHLVHPSCHGSGAQEVPSSRPQAALIWSREINGPPRDHLSSSPLLESSLSSTIQVDKNQGSLPCGAKELDIMSNTPPPRPPKPSHLSERRQEEWSTHSGSKKPECTLVPRRISLSGLDNMRTWKADVEGQSLRHRDKRLSLNLPCRFSPMYPTASASIEDSYVPMSPQAGASGLGPHCSPDDYIPMNSGSISSPLPELPANLEPPPVNRDLKPQRKSRPPPLDLRNLSIIREHASLTRTRTVPCSRTSFLSPERNGINSARFFANPVSREDEESYIEMEEHRTASSLSSGALTWTKKFSLDYLALDFNSASPAPMQQKLLLSEEQRVDYVQVDEQKTQALQSTKQEWTDERQSKV

SEQ ID NO: 12856 - protein, 587 aa, Homo sapiens
MSAGDAVCTGWLVKSPPERKLQRYAWRKRWFVLRRGRMSGNPDVLEYYRNKHSSKPIRVIDLSECAVWKHVGPSFVRKEFQNNFVFIVKTTSRTFYLVAKTEQEMQVWVHSISQVCNLGHLEDGAADSMESLSYTPSSLQPSSASSLLTAHAASSSLPRDDPNTNAVATEETRSESELLFLPDYLVLSNCETGRLHHTSLPTRCDSWSNSDRSLEQASFDDVFVDCLQPLPSSHLVHPSCHGSGAQEVPSSRPQAALIWSREINGPPRDHLSSSPLLESSLSSTIQVDKNQGSLPCGAKELDIMSNTPPPRPPKPSHLSERRQEEWSTHSGSKKPECTLVPRRISLSGLDNMRTWKADVEGQSLRHRDKRLSLNLPCRFSPMYPTASASIEDSYVPMSPQAGASGLGPHCSPDDYIPMNSGSISSPLPELPANLEPPPVNRDLKPQRKSRPPPLDLRNLSIIREHASLTRTRTVPCSRTSFLSPERNGINSARFFANPVSREDEESYIEMEEHRTASSLSSGALTWTKKFSLDYLALDFNSASPAPMQQKLLLSEEQRVDYVQVDEQKTQALQSTKQEWTDERQSKV

SEQ ID NO: 12857 - protein, 574 aa, Homo sapiens
MSLPSPSPSRELCPPDPAFAPLSSWPGSGPAGGSTRSGHVLYSGWLRKSPPEKKLRLFAWRKRWFILRRGQTSSDPDVLEYYKNDGSKKPLRTINLNLCEQLDVDVTLNFNKKEIQKGYMFDIKTSERTFYLVAETREDMNEWVQSICQICGFRQEESTGFLGNISSASHGLCSSPAEPSCSHQHLPQEQEPTSEPPVSHCVPPTWPIPAPPGCLRSHQHASQRAEHARSASFSQGSEAPFIMRRNTAMQNLAQHSGYSVDGVSGHIHGFHSLSKPSQHNAEFRGSTHRIPWSLASHGHTRGSLTGSEADNEASSGKYTQHGGGNASRPAESMHEGVCSFLPGRTLVGLSDSIASEGSCVPMNPGSPTLPAVKQAGDDSQGVCIPVGSCLVRFDLLGSPLTELSMHQDLSQGHEVQLPPVNRSLKPNQKANPTPPNLRNNRVINELSFKPPVTEPWSGTSHTFDSSSSQHPISTQSITNTDSEDSGERYLFPNPASAFPVSGGTSSSAPPRSTGNIHYAALDFQPSKPSIGSVTSGKKVDYVQVDLEKTQALQKTMHEQMCLRQSSEPPRGAKL

SEQ ID NO: 12858 - protein, 118 aa, Homo sapiens
MESVALYSFQATESDELAFNKGDTLKILNMEDDQNWYKAELRGVEGFIPKNYIRVKPHPWYSGRISRQLAEEILMKRNHLGAFLIRESESSPGEFSVSVNNRAQRGPCLGPKSHSRLG

SEQ ID NO: 12859 - protein, 188 aa, Homo sapiens
MEDDQNWYKAELRGVEGFIPKNYIRVKPHPWYSGRISRQLAEEILMKRNHLGAFLIRESESSPGEFSVSVNYGDQVQHFKVLREASGKYFLWEEKFNSLNELVDFYRTTTIAKKRQIFLRDEEPLLKSPGACFAQAQFDFSAQDPSQLSFRRGDIIEVLERPDPHWWRGRSCGRVGFFPRSYVQPVHL

SEQ ID NO: 12860 - protein, 40 aa, Homo sapiens
MLLREITYSITPLSLHGTSLLNCNWRATGLVTLEGHRPFQ

SEQ ID NO: 12861 - protein, 266 aa, Homo sapiens
MVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQVCGAARGSVPSQGAPPHLQPGGCSDHPEGAQDGHQWA

SEQ ID NO: 12862 - protein, 344 aa, Homo sapiens
MQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQVCGAARGSVPSQGAPPHLQPGGCSDHPEGAQDGHQWA

SEQ ID NO: 12863 - protein, 336 aa, Homo sapiens
MQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQKIFSEPGSLSMATVAKLRESCRARLLAQG

SEQ ID NO: 12864 - protein, 1217 aa, Homo sapiens
MKGMSHEPKSPSLGMLSTATRTTATVNPLTPSPLNGALVPSGSPATSSALSAQAAPSSSFAAALRKLAKQAEEPRGSSLSSESSPVSSPATNHSSPASTPKRVPMGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 12865 - protein, 1113 aa, Homo sapiens
MGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 12866 - protein, 820 aa, Homo sapiens
MVVDFCRRFVARSLCIILMKHFCSSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRVKFNQKICTRFHLETSWAEASNDL

SEQ ID NO: 12867 - protein, 1013 aa, Homo sapiens
MVVDFCRRFVARSLCIILMKHFCSSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 12868 - protein, 268 aa, Homo sapiens
MDPLTKVPCGSQIAQTILWKAKSSLSFGIQPLQTWPTKDPELESQVNLSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKG

SEQ ID NO: 12869 - protein, 991 aa, Homo sapiens
MKSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 12870 - protein, 268 aa, Homo sapiens; identical to SEQ ID NO: 12868

SEQ ID NO: 12871 - protein, 300 aa, Homo sapiens
MAESEDRSLRIVLVGKTGSGKSATANTILGEEIFDSRIAAQAVTKNCQKASREWQGRDLLVVDTPGLFDTKESLDTTCKEISRCIISSCPGPHAIVLVLLLGRYTEEEQKTVALIKAVFGKSAMKHMVILFTRKEELEGQSFHDFIADADVGLKSIVKECGNRCCAFSNSKKTSKAEKESQVQELVELIEKMVQCNEGAYFSDDIYKDTEERLKQREEVLRKIYTDQLNEEIKLVEEDKHKSEEEKEKEIKLLKLKYDEKIKNIREEAERNIFKDVFNRIWKMLSEIWHRFLSKCKFYSS

SEQ ID NO: 12872 - protein, 68 aa, Homo sapiens
MSGFSSVAATKKVVQQLQLEAGLNSVKVSQAAADLKQFCLQNAQHDPLLTGVSSSTNPFRPQKVCSFL

SEQ ID NO: 12873 - protein, 522 aa, Homo sapiens
MVRSGKNGDLHLKQIAYYKRTGEYHSTTLPSERSGIRRAAKKFVFKEKKLFYVGKDRKQNRLVIVSEEEKKKVLRECHENDSGAHHGISRTLTLVESNYYWTSVTNDVKQWVYACQHCQVAKNTVIVAPKQHLLKVENPWSLVTVDLMGPFHTSNRSHVYAIIMTDLFTKWIVILPLCDVSASEVSKAIINIFFLYGPPQKIIMDQRDEFIQQINIELYRLFGIKQIVISHTSGTVNPTESTPNTIKAFLSKHCADHPNNWDDHLSAVSFAFNVTHLEPTKNTPYFQMFSRNPYMPETSDSLHEVDGDNTSMFAKILDAIKEADKIMENKTTSLGQMENNNLDELNKSKIIVKKKPKQLNPFHLKVGHEVLRQRKNWWKDGRFQSEWVGPCVIDYITESGCAVLRDNTGVRLKRPIKMSHLKPYIRESSEQESLYLLQGSVVADHDYIGLPEIPIGAYQANILVEDATIGIVDNELLTSSKDRELLEYRNTKISPLIDDHSSLEKQTFSLLDSSNQVLEYLS

SEQ ID NO: 12874 - protein, 222 aa, Homo sapiens
MVRSGKNGDLHLKQIAYYKRTGEYHSTTLPSERSGIRRAAKKFVFKEKKLFYVGKDRKQNRLVIVSEEEKKKVLRECHENDSGAHHGISRTLTLVESNYYWTSVTNDVKQWVYACQHCQVAKNTVIVAPKQHLLKVENPWSLVTVDLMGPFHTSNRSHVYAIIMTDLFTKWIVILPLCDVSASEVSKAIINIFFLYGPPQKIIMDQRDEFIQQKVFISCKVQ

SEQ ID NO: 12875 - protein, 228 aa, Homo sapiens
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 12876 - protein, 251 aa, Homo sapiens
MAAPPQPVTHLIFDMDGLLLGYTGSIVAAASGESSRGLQSRWTDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 12877 - protein, 208 aa, Homo sapiens
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKSSIHRPRLLTAQKCQGCRDPFSALLLLCNQLLLCSDDT

SEQ ID NO: 12878 - protein, 244 aa, Homo sapiens
MAAPPQPVTHLIFDGRTSSGWVVAAASGRSCVGVGTDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 12879 - protein, 185 aa, Homo sapiens
MAAPPQPVTHLIFDMDGLLLDTERLYSVVFQEICNRYDKKYSWDVKSLVMGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 12880 - protein, 259 aa, Homo sapiens
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGLALGPGPFVTALEYATDTKATVVGKPEKTFFLEALRGTGCEPEEAVMIGDDCRDDVGGAQDVGMLGILVKTGKYRASDEEKINPPPYLTCESFPHAVDHILQHLL

SEQ ID NO: 12881 - protein, 43 aa, Homo sapiens
MAIPITVLDCDLLLYGRGHRTLDRFKLDDVTDEYLMSMYGFPR

SEQ ID NO: 12882 - protein, 84 aa, Homo sapiens
MKREPKNLSSEQVLKPTYSQSKPNRIRLYYWGLGLNLRAAASEANRMESKKVGKRLGAGKQQMGAELTEQHMARISLPAKILGY

SEQ ID NO: 12883 - protein, 59 aa, Homo sapiens
MQTGGCEPKHRRMCPDDSSENIMKWRTFLPEERTVTQAGDVTHTLGSKGPKAGVPFTGP

SEQ ID NO: 12884 - protein, 122 aa, Homo sapiens
MVVVEKGASLMSRASLMPAQARAPFQRLRDCRGPADSSHAFKLQCFPSHCRRPPWVISRKGRAINKYSICISCVALHLEISFIWQLLQNEPNLEGGLGRFMLASLSLQQVISILAFTRVKQL

SEQ ID NO: 12885 - protein, 60 aa, Homo sapiens
MALPCGMGTAWYLDSTENALTVNVPRAQNHKASHNSMWKLGSHFYCILLVTKDPPGFTMV

SEQ ID NO: 12886 - protein, 130 aa, Homo sapiens
MSLCSLLSPRSGFRCCCAAPPPPAQPHQEAQGGLVELLMHAAARKTLFNFPPAPSRASPGHRVACQPDRARKSGSWAVAQRRREQEEAGARAGAVDPLGLPLVSSISCVQHCNLAAGVQTGRPPASSTDC

SEQ ID NO: 12887 - protein, 53 aa, Homo sapiens
ATQDLQFRIRRPRPPARGRGGETRSCDLGRCHLKGLDLLEARTAEEDGERNAR

SEQ ID NO: 12888 - protein, 137 aa, Homo sapiens
MFHFFRKPPESKKPSVPETEADGFVLLGDTTDEQRMTARGKTSDIEANQPLETNKENSSSVTVSDPEMENKAGQTLENSSLMAELLSDVPFTLAPHVLAVQGTITDLPDHLLSYDGSENLSRFWYDFTLENSVLCDS

SEQ ID NO: 12889 - protein, 291 aa, Homo sapiens
MPGKLLPEKCALMWLHLGTRAPQRPKRESRGFPGWGCRTGQALPCRARPPAPAPSHPSSSLSLTPGPGSPRQTGPPCQTVAALYGLGAWQSHCGGGVGCHGQGRQPLGCQGWWSTLNPYLLESPGLFHTRSCGKLWDPKAVLISGVTSSHSSLGSPGTRPGVSLCKELPGCWAELCCRPRKMTKKDRAEPHLPLLGGPEGARAQQSPILHSLGSKRLPRCGWQLLTSSGGAAGGLCPMGHRREKDGGRVCTLGRTGGRHRPEQVAWAHEKGVSETGCLSQMPGVDEADEWQ

SEQ ID NO: 12890 - protein, 77 aa, Homo sapiens
MKAPGLAQAAVAEETPDWAPELCPSSEARSPEPPANRLQDFDTLVTVGKQLEAICVKKNVDLLARMQRRERLLIRCW

SEQ ID NO: 12891 - protein, 137 aa, Homo sapiens
MTSPLVFASLSPDAMAKMLEMAALNVGTIRISLNTEPRPPVITQLAPSPETLPFCPEWGAENQSRHLKLPPFFICRCRGPLYQEESLSEIHCHSGLFLDQLSLPTPFSSLSVSLIHWTFISTKYVPGIMLAFGGTNK

SEQ ID NO: 12892 - protein, 46 aa, Homo sapiens
REGHADGNIPAGPGLCSPQLLLPGGQLFWAPEVLRSPFPGPGTPSA

SEQ ID NO: 12893 - protein, 147 aa, Homo sapiens
MGLLSLILFLGAKVTTANKTDSFLFSTGLTVLSSPGLKMRVLGCPPTPPQLTQGHTSGYVDLHKGPFLSPMRHPRGHTGPQILPQAWEPIGRRVRQCRGPQTFLKGPESKYFRLCRPDVLCCKTQFCYCSSKAAIDNSEVNECVVSQ

SEQ ID NO: 12894 - protein, 27 aa, Homo sapiens
DILQHNHPVVGLLQVGSEHGSEEAALS

SEQ ID NO: 12895 - protein, 184 aa, Homo sapiens
MPVKGASSLLFLPLPPSAWQLCLLSKRRVHPIRTPLPFHSWIKALVISNQKVPERERPEGTGVLSDGCLGQSQEGEPLLSPPALAHFPLHARCCGSSWAWPGSAGEAIRMVSGAPFLCFLDGLDGLPCSSPMAALPAPMAALPARRQRQEHIEGGSQGCGVRSPAPCRGKPGSATSSTLRLCPA

SEQ ID NO: 12896 - protein, 138 aa, Homo sapiens
MLEKWRETEEARGLLTRTQPTASGPPCSHAHSQLLLDRLKGNLARRGGVGRASLETVLWRPGETAFYPQHWGEQASIPAFACRPSSFPLKAYPAAPALRNALLSYQLWERQDRLASGRRGRHCLPSGPGPHRYPQLQD

SEQ ID NO: 12897 - protein, 142 aa, Homo sapiens
MGLYHVGQAGLELLTSSDPPTSASQNAEITGVSHRAQSKAHNLQRKLRLSHKSSPPCTYTQHAGGVDSHPLTQDMCVIVNVIARPFDKCNCDIYLGLASELFVVSWVQLTVPYHWIQTLGNVILFCLDTAHRGHCDIAGHCT

SEQ ID NO: 12898 - protein, 100 aa, Homo sapiens
MRPKHLQGIAPEVFRTPTGSHGQMPGQPLQRGHALDIRPPLRPHPLISGHALRGDRWQTPALALGPALCGFVPAHWVLTVPPPQRPSIPSRSADTCPASR

SEQ ID NO: 12899 - protein, 81 aa, Homo sapiens
MVFLNYKCTTPLILLLPSQIPRSYKQDWLLYCSKLISLAYHAFLIFMPSLMMFSLLEIYHILLPQLLLQVNFLLKAEPDQI

SEQ ID NO: 12900 - protein, 144 aa, Homo sapiens
MKVSSLTRQQRPPQGTEAGTRGGGPGRLSPERCRLLDSPLQLQGPASLPQPGGRERAVATPPQATRRGGSERTRDSLLGAVGPSGAKRPFFSSALPKGCRRVGATWGPRQRGWGNATGGPGEGARRSRPDPQALFWHAPHLRAQ

SEQ ID NO: 12901 - protein, 105 aa, Homo sapiens
MAHCSLDLSGSGDPPTSTSQVARTIGACHHVQLIFVFFGETGFHHVAPLVLELLDSSDPPTLASQSGGNRHEPPHRALKHIFLKHIWLFSFYFHQNGHEETMDQI

SEQ ID NO: 12902 - protein, 131 aa, Homo sapiens
MPFWRLDKLSPGGVKRLRVTQPATGTGVVRSQCQKWVKELGNVPRLAARKPGLGVPGSSGAVKRQGQKWVKELGNIPRLAVGRDQGLGSLDPGSATELLCDCSVPLLPLSGGYRKADVAHHPACAIVWLHY

SEQ ID NO: 12903 - protein, 147 aa, Homo sapiens
MVTGPCLTCVSSLIERASPNHPTNKGLTLLPWLECSGPIIAHCSLDFPASVDPPTLISRVAGTAGLLILRFSSASANPETARPIPPLPCPPPRLLHMKTTRMKTFMMIHFHLMNKLQEIIQEERHGGMLESLLSLKVGNPGSCSCSH

SEQ ID NO: 12904 - protein, 67 aa, Homo sapiens
MFHLCKLNPSYLKITCGKRSKQITPTYYPSRLPPVKRKFSVYDAKLTIVHLSTFSIEDFPLYLSMAG

SEQ ID NO: 12905 - protein, 140 aa, Homo sapiens
MGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEVKIQ

SEQ ID NO: 12906 - protein, 179 aa, Homo sapiens
MGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEGWSEHRVQEYFEWAAQVVKGLQGTNRQLEEALKHLFKQRGLTI

SEQ ID NO: 12907 - protein, 543 aa, Homo sapiens
MPNPKNSKGGRKNKRANSSGDEQENGAGALAAAGAAGAAAGGALAAAAGCGAAAAGAPGAGGAAGAGGAGTGAANAAAAAGAAAAGDAKNEAPCATPLICSFGRPVDLEKDDYQKVVCNNEHCPCSTWMHLQCFYEWESSILVQFNCIGRARSWNEKQCRQNMWTKKGYDLAFRFCSCRCGQGHLKKDTDWYQVKRMQDEKKKKSGSEKNTGRPPGEAAEEAKKCRPPNKPQKGPSHDLPRRHSMDRQNSQEKAVGAAAYGARSPGGSPGQSPPTGYSILSPAHFSGPRSSRYLGEFLKNAIHLEPHKKAMAGGHVFRNAHFDYSPAGLAVHRGGHFDTPVQFLRRLDLSELLTHIPRHKLNTFHVRMEDDAQVGQGEDLRKFILAALSASHRNVVNCALCHRALPVFEQFPLVDGTLFLSPSRHDEIEYDVPCHLQGRLMHLYAVCVDCLEGVHKIICIKCKSRWDGSWHQLGTMYTYDILAASPCCQARLNCKHCGKPVIDVRIGMQYFSEYSNVQQCPHCGNLDYHFVKPFSSFKVLEAY

SEQ ID NO: 12908 - protein, 855 aa, Homo sapiens
MAALGVAEAVAAPHPAEGAETAEAVELSRALSRLLPGLEADSKPGRRRALEALRRALEEPGPAADPTAFQGPWARLLLPRLLRCLSDPAEGCRALAVHLLDLGLRRAARPRDALPRLLPALAARLAGPVPARRPPEACEELRLALVQLLGLAVDLCGAALAPHLDDALRALRCSLLDPFAAVRRESCSCAAALAQATPDHFHMQSESLIGPLMQTISHQHWKVRVAAIEATGAVIHFGNGKSVDDVLSHFAQRLFDDVPQVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 12909 - protein, 843 aa, Homo sapiens
MAALGVAEAVAAPHPAEGAETAEAVELSRALSRLLPGLEADSKPGRRRALEALRRALEEPGPAADPTAFQGPWARLLLPRLLRCLSDPAEGCRALAVHLLDLGLRRAARPRDALPRLLPALAARLAGPVPARRPPEACEELRLALVQLLGLAVDLCGAALAPHLDDALRALRCSLLDPFAAVRRESCSCAAALAQATPDHFHMQSESLIGPLMQTISHQHWKVRVAAIEATGAVIHFGNGKSVDDVLSHFAQRLFDDVPQVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILDVPGSPSPSAMIGSFLRPPHPWRTVSQLNLFSS

SEQ ID NO: 12910 - protein, 601 aa, Homo sapiens
MDSFSEVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 12911 - protein, 680 aa, Homo sapiens
MGKSRTKRFKRPQFSPTGDCQAEAAAAANGTGGEEDDGPAAELLEKLQHPSAEVRECACAGLARLVQQRPALPGLARRDAVRRLGPLLLDPSLAVRETAAGALRNLSACGGFEVCDDMVTKDIMTPLVALLKECSAGLDSNEMSLQEKKDQNRNSIENIANETVNVLWNICECSSRAVSIFNKEGCLEIVLKYLSRFPTNVDLAISVAYCLQTVTEDNPELLKSFSATALNMLESALLSPVSSMESLLLKTLVAGTIWNLKDIIPCKSQAEIINALLKILSEVLGMDAGEMVIQMKEAETQRLKTAAEAEEILENTNGDDLIEDDEMEGISHKRRVRRKTFVSDLLPPTDKELRETIALLTAQQTALEIIVNMCCNEDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 12912 - protein, 1026 aa, Homo sapiens
MTRTQKGKTFLPHCFYQSLPPRLGWGMILNYSKLKGKEECASVSSVPMVFFSSQYRLHRKSQYLKMAAANLTFSQEVVWQRGLPSIPYSQYSFDHLYNTNDIIHTPQIRKARPQKPVSFKFLGSSSPLTGDTSLAVKTESSANPEKKLKKSKPASTVREAPRPLIHHPCMHPDMLGRPPSLDVNLEEREAWLLPPEKEARAWEATVLEKLNERTARWIQSKRPRRPGASPNKWQSFLRQQYDWSHIRDELTSASDLELLKQLEAEETAEFEDQSVILPPQEKKKPELLLPVYYRLPSYFQQAETVEIMPGNKSTEDIHEKTSLSQPQTQSYFRQVTPRAGKFAYSTDNTFEQEIYFDEVQIIHQIGAKRDQIVLENLNRYNKQLSKVFPETPEKWSAQAIPEASYRPVQGALRWTALPTPAKDMLLQVGEKDVPIKTRRLKKQAKSLQEDVTWELVVLRRMLKEWKTAWALIIEWHHETVENLLQSLGDLHDDVRIKAITTCATAALERPRIATSQRDSDKTIQDLPEVLLPALEAALCDKNAHVRMAAAICQYAIQSHNPLARNIMQTALLKGNSVDSWAAAQCLALEGTATYPVIKRILHQLFTKKNEDTEEQSYILLSYLSEKTTLIHTMLAVELNSCQWKNRIVACQAFSRISGNVCLDMKHKLIQLMWNDWNKEVRRAAAQALGQMSLGKEVHDIIRVKLGQGNSQERVEALYLIGELKLMTAKLLPSFLHCFSDDFTAVRRAACLAAGALQIRDKMVLECLLNLMQRDPYWKIKAFAIRALGQIGQVSPELTDLLLWAIHYEESPGVRLEACRSILALKLQGDRVRDTFLDVLLLENHDAVLKEMYQTMKILNLGNEGNQEMLQEIKNRIKTLSQKDLLTHKILKLEMVMGKVREEAKRVYLKPKGEQGPLTLQTLLQETFQDEMVLPRRPSEVCDTEAVIKPVKPRAPNPWLQSSVPGLTTRSKVRSSLVKDLRTSPEKRIAVGPFRSDYPALYLGKFSERTFFSPIMSSPSGKKGAHL

SEQ ID NO: 12913 - protein, 1026 aa, Homo sapiens; identical to SEQ ID NO: 12912

SEQ ID NO: 12914 - protein, 191 aa, Homo sapiens
MTRTQKGKTFLPHCFYQSLPPRLGWGMILNYSKLKGKEECASVSSVPMVFFSSQYRLHRKSQYLKMAAANLTFSQEVVWQRGLPSIPYSQYSFDHLYNTNDIIHTPQIRKARPQKPVSFKFLGSSSPLTGDTSLAVKTESSANPEKKLKKSKPASTVREAPRPLIHHPCMHPDMLGRPPSLDVNLEEREAW

SEQ ID NO: 12915 - protein, 39 aa, Homo sapiens
MTRTQKGKTFLPHCFYQSLPPRLGWGMILNYSKLKGKEE

SEQ ID NO: 12916 - protein, 979 aa, Homo sapiens
MVFFSSQYRLHRKSQYLKMAAANLTFSQEVVWQRGLPSIPYSQYSFDHLYNTNDIIHTPQIRKARPQKPVSFKFLGSSSPLTGDTSLAVKTESSANPEKKLKKSKPASTVREAPRPLIHHPCMHPDMLGRPPSLDVNLEEREAWLLPPEKEARAWEATVLEKLNERTARWIQSKRPRRPGASPNKWQSFLRQQYDWSHIRDELTSASDLELLKQLEAEETAEFEDQSVILPPQEKKKPELLLPVYYRLPSYFQQAETVEIMPGNKSTEDIHEKTSLSQPQTQSYFRQVTPRAGKFAYSTDNTFEQEIYFDEVQIIHQIGAKRDQIVLENLNRYNKQLSKVFPETPEKWSAQAIPEASYRPVQGALRWTALPTPAKDMLLQVGEKDVPIKTRRLKKQAKSLQEDVTWELVVLRRMLKEWKTAWALIIEWHHETVENLLQSLGDLHDDVRIKAITTCATAALERPRIATSQRDSDKTIQDLPEVLLPALEAALCDKNAHVRMAAAICQYAIQSHNPLARNIMQTALLKGNSVDSWAAAQCLALEGTATYPVIKRILHQLFTKKNEDTEEQSYILLSYLSEKTTLIHTMLAVELNSCQWKNRIVACQAFSRISGNVCLDMKHKLIQLMWNDWNKEVRRAAAQALGQMSLGKEVHDIIRVKLGQGNSQERVEALYLIGELKLMTAKLLPSFLHCFSDDFTAVRRAACLAAGALQIRDKMVLECLLNLMQRDPYWKIKAFAIRALGQIGQVSPELTDLLLWAIHYEESPGVRLEACRSILALKLQGDRVRDTFLDVLLLENHDAVLKEMYQTMKILNLGNEGNQEMLQEIKNRIKTLSQKDLLTHKILKLEMVMGKVREEAKRVYLKPKGEQGPLTLQTLLQETFQDEMVLPRRPSEVCDTEAVIKPVKPRAPNPWLQSSVPGLTTRSKVRSSLVKDLRTSPEKRIAVGPFRSDYPALYLGKFSERTFFSPIMSSPSGKKGAHL

SEQ ID NO: 12917 - protein, 2040 aa, Homo sapiens
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKLAAVVCLGSLYKKLGRILGNTFTDTVGNILKAMKSAESQGRYEIMLSLQNILNGLGAAAAPCHRDVYKAARSCLTDRSMAVRCAAAKNEAIFMWSTDLDSVATLCFKSFEGSNYDVRISVSKLLGIILAKAVISKHPGTAASRQSIRRVSLEEVLELLGTGFLRGSSGFLRASGDMLKGTSSVSRDVRVGVTQAYVVFVSTLGGAWLEKNFAAFFSHILSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEGSISILPTILYLTIGVLRETAVKLPGGQLSSTVAASLQALKGILSSPMARAEKSRTAWTDLLRSALTTILDCWDPVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 12918 - protein, 1140 aa, Homo sapiens
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKLAAVVCLGSLYKKLGRILGNTFTDTVGNILKAMKSAESQGRYEIMLSLQNILNGLGAAAAPCHRDVYKAARSCLTDRSMAVRCAAAKCLLELQNEAIFMWSTDLDSVATLCFKSFEGSNYDVRISVSKLLGIILAKAVISKHPGTAASRQSIRRVSLEEVLELLGTGFLRGSSGFLRASGDMLKGTSSVSRDVRVGVTQAYVVFVSTLGGAWLEKNFAAFFSHILSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPVFTASSPGVDSICRNHLE

SEQ ID NO: 12919 - protein, 1965 aa, Homo sapiens
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKLAAVVCLGSLYKKLGRILGNTFTDTVGNILKAMKSAESQGRYEIMLSLQNILNGLGAAAAPCHRDVYKAARSCLTDRSMAVRCAAAKNEAIFMWSTDLDSVATLCFKSFEGSNYDVRISVSKLLGIILAKAVISKHPGTAASRQSIRRVSLEEVLELLGTGFLRGSSGFLRASGDMLKGTSSVSRDVRVGVTQAYVVFVSTLGGAWLEKNFAAFFSHILSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 12920 - protein, 1753 aa, Homo sapiens
MLKGTSSVSRDVRVGVTQAYVVFVSTLGGAWLEKNFAAFFSHILSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEGSISILPTILYLTIGVLRETAVKLPGGQLSSTVAASLQALKGILSSPMARAEKSRTAWTDLLRSALTTILDCWDPVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 12921 - protein, 2046 aa, Homo sapiens
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKLAAVVCLGSLYKKLGRILGNTFTDTVGNILKAMKSAESQGRYEIMLSLQNILNGLGAAAAPCHRDVYKAARSCLTDRSMAVRCAAAKCLLELQNEAIFMWSTDLDSVATLCFKSFEGSNYDVRISVSKLLGIILAKAVISKHPGTAASRQSIRRVSLEEVLELLGTGFLRGSSGFLRASGDMLKGTSSVSRDVRVGVTQAYVVFVSTLGGAWLEKNFAAFFSHILSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEGSISILPTILYLTIGVLRETAVKLPGGQLSSTVAASLQALKGILSSPMARAEKSRTAWTDLLRSALTTILDCWDPVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 12922 - protein, 2071 aa, Homo sapiens
MELAHSLLLNEEALAQITEAKRPVFIFEWLRFLDKVLVAANKTDVKEKQKKLVEQLTGLISSSPGPPTRKLLAKNLAALYSIGDTFTVFQTLDKCNDIIRNKDDTAAYLPTKLAAVACVGAFYEKMGRMLGSAFPETVNNLLKSLKSAESQGRSEILMSLQKVLSGLGGAAASSHRDIYKNARSLLTDRSMAVRCAVAKCLLELQNEAVFMWTAELENIATLCFKALENSNYGVRVAVSKLLGTVMATALMPKQATVMRQNVKRATFDEVLELMATGFLRGGSGFLKSGGEMLKVGGSVNREVRVGVTQAYVVFVTTLGGQWLERSFATFLSHVLDLVSHPRATQTHVEAVYSRRCVSFILRATVGSLLGEKAQIAAAKEICQAIGKQMKAVEAVVNDTSGENKSGAADIAASQHVMVCALQELGSLVQSLNATASPLIQEASIGLLEIVTSVLLHPSMAARLAAAWCLRCVAVALPFQLTPFLDRCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 12923 - protein, 1982 aa, Homo sapiens
MELAHSLLLNEEALAQITEAKRPVFIFEWLRFLDKVLVAANKTDVKEKQKKLVEQLTGLISSSPGPPTRKLLAKNLAALYSIGDTFTVFQTLDKCNDIIRNKDDTAAYLPTKLAAVACVGAFYEKMGRMLGSAFPETVNNLLKSLKSAESQGRSEILMSLQKVLSGLGGAAASSHRDIYKNARSLLTDRSMAVRCAVAKCLLELQNEAVFMWTAELENIATLCFKALENSNYGVRVAVSKLLGTVMATALMPKQATVMRQNVKRATFDEVLELMATGFLRGGSGFLKSGGEMLKVGGSVNREVRVGVTQAYVVFVTTLGGQWLERSFATFLSHVLDLVSHPRATQTHVEAVYSRRCVSFILRATVGSLLGEKAQIAAAKEICQAIGKQMKAVEAVVNDTSGENKSGAADIAASQHVMVCALQELGSLVQSLNATASPLIQEASIGLLEIVTSVLLHPSMAARLAAAWCLRCVAVALPFQLTPFLDRCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLRCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 12924 - protein, 768 aa, Homo sapiens
MELAHSLLLNEEALAQITEAKRPVFIFEWLRFLDKVLVAANKTDVKEKQKKLVEQLTGLISSSPGPPTRKLLAKNLAALYSIGDTFTVFQTLDKCNDIIRNKDDTAAYLPTKLAAVACVGAFYEKMGRMLGSAFPETVNNLLKSLKSAESQGRSEILMSLQKVLSGLGGAAASSHRDIYKNARSLLTDRSMAVRCAVAKCLLELQNEAVFMWTAELENIATLCFKALENSNYGVRVAVSKLLGTVMATALMPKQATVMRQNVKRATFDEVLELMATGFLRGGSGFLKSGGEMLKVGGSVNREVRVGVTQAYVVFVTTLGGQWLERSFATFLSHVLDLVSHPRATQTHVEAVYSRRCVSFILRATVGSLLGEKAQIAAAKEICQAIGKQMKAVEAVVNDTSGENKSGAADIAASQHVMVCALQELGSLVQSLNATASPLIQEASIGLLEIVTSVLLHPSMAARLAAAWCLRCVAVALPFQLTPFLDRCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLLLFLVH

SEQ ID NO: 12925 - protein, 1181 aa, Homo sapiens
MAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQVIVDEQHLDFLLAYTISAIHQCSSWTHREILQALAALVYCNGSKCQKYLPELLGNTGLLMKLSDLAQSDPEVRRAAVHCMANLCLSVPGQPYLEEPYQNVCFQAFLTILQSPKSSDMDDITFCMLLQNALKGIQSLLNGGRMKLTQTDELGALLAVLKKFMFHGLPGLNIEMPTVLYPTPLPQYDGRTPIKPQQSESSASRPTLNKKKKSKVKPKKIQQGEEEEKESSGEIEAAPVTGTGRVNLHEGNTWCPSSLGVQSLPLDGSGAAEKDGVSSSFSSSSWKRVSSSESDFSDAEGGMQSKMRSYQAKVRQGALVCFLSTIKSIEKKVLYGYWSAFIPDTPELGSPQSVSLMTLTLKDPSPKTRACALQVLSAILEGSKQFLSVAEDTSDHRRAFTPFSVMIACSIRELHRCLLLALVAESSSQTVTQIIKCLANLVSNAPYDRLKLSLLTKVWNQIKPYIRHKDVNVRVSSLTLLGAIVSTHAPLPEVQLLLQQPCSSGLGNSNSATPHLSPPDWWKKAPAGPSLEETSVSSPKGSSEPCWLIRLCISIVVLPKEDSCSGSDAGSAAGSTYEPSPMRLEALQVLTLLARGYFSMTQAYLMELGEVICKCMGEADPSIQLHGAKLLEELGTGLIQQYKPDSTAAPDQRAPVFLVVMFWTMMLNGPLPRALQNSEHPTLQASACDALSSILPEAFSNLPNDRQMLCITVLLGLNDSKNRLVKAATSRALGVYVLFPCLRQDVIFVADAANAILMSLEDKSLNVRAKAAWSLGNLTDTLIVNMETPDPSFQEEFSGLLLLKMLRSAIEASKDKDKVKSNAVRALGNLLHFLQPSHIEKPTFAEIIEESIQALISTVLTEAAMKVRWNACYAMGNVFKNPALPLGTAPWTSQAYNALTSVVTSCKNFKVRIRSAAALSVPGKREQYGSVDQYARIWNALVTALQKSEDTIDFLEFKYCVSLRTQICQALIHLLSLASASDLPCMKETLELSGNMVQSYILQFLKSGAEGDDTGAPHSPQERDQMVRMALKHMGSIQAPTGDTARRAIMGFLEEILAVCFDSSGSQGALPGLTNQ

SEQ ID NO: 12926 - protein, 916 aa, Homo sapiens [sequence omitted]

SEQ ID NO: 12927 - protein, 1641 aa, Homo sapiens
MTESSMKKLASTLLDAITDKDPLVQEQVCSALCSLGEARPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKVLGIKVETKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYPQLFVVLLLRVSCTVGVQLPRNLQAQERRGASPALATRNLEPCSSAVDTLRSMLLRSGSEDVVQRMDLEGGWELLRTSAGHEEGATRLARAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 12928 - protein, 340 aa, Homo sapiens
MERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAGECLHASLAATPGHVQDGAGPGRLCPSK

SEQ ID NO: 12929 - protein, 1641 aa, Homo sapiens; identical to SEQ ID NO: 12927

SEQ ID NO: 12930 - protein, 550 aa, Homo sapiens
MINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYPQLFVVLLLRVSCTVGVQLPRNLQAQERRGASPALATRNLEPCSSAVDTLRSMLLRSGSEDVVQRMDLEGGWELLRTSAGHEEGATRLARAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAAPLLYPQRSRSC

SEQ ID NO: 12931 - protein, 422 aa, Homo sapiens
MTESSMKKLASTLLDAITDKDPLVQEQVCSALCSLGEARPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAGSTNTRITLMLPSAVTRLKHEDCPARAAPQPADLTAAPASVA

SEQ ID NO: 12932 - protein, 1641 aa, Homo sapiens; identical to SEQ ID NO: 12927

SEQ ID NO: 12933 - protein, 615 aa, Homo sapiens
MRIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYPQLFVVLLLRVSCTVGVQLPRNLQAQERRGASPALATRNLEPCSSAVDTLRSMLLRSGSEDVVQRMDLEGGWELLRTSAGHEEGATRLARAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGKHHPLPHPHAARQPRLMPPLHRVPGAALGAQAAAAGGPGPAHCGAPDPAEGPGPRGADEGC

SEQ ID NO: 12934 - protein, 1641 aa, Homo sapiens; identical to SEQ ID NO: 12927

SEQ ID NO: 12935 - protein, 1290 aa, Homo sapiens
MKASSCFLILAHSNPGELMEFFDEQVRSNNEAIRVGILTLLRLAVNADEPRLRDHIISIERTVKIVMGDLSTKVRNSVLLLIQTMCEKSYIEAREGWPLIDYVFSQFATLNRNLEKPVKTNFHENEKEEESVRETSLEVLKTLDPLVIGMPQVLWPRILTFVVPAEYTEALEPLFSIIRILIMAEEKKQHSAKESTALVVSTGAVKLPSPQQLLARLLVISMPASLGELRGAGAIGLLKILPEIIHPKLVDLWKTRLPELLQPLEGKNISTVLWETMLLQQLLKESLWKISDVAWTIQLTQDFKQQMGSYSNNSTEKKFLWKALGTTLACCQDSDFVNSQIKEFLTAPNQLGDQRQGITSILGYCAENHLDIVLKVLKTFQNQEKFFMNRCKSLFSGKKSLTKTDVMVIYGAVALHAPKKQLLSRLNQDIISQVLSLHGQCSQVLGMSVMNKDMDLQMSFTRSITEIGIAVQDAEDQGFQFSYKEMLIGYMLDFIRDEPLDSLASPIRWKALIAIRYLSKLKPQLSLQDHLNILEENIRRLLPLPPLENLKSEGQTDKDKEHIQFLYERSMDALGKLLKTMMWDNVNAEDCQEMFNLLQMWLVSQKEWERERAFQITAKVLTNDIEAPENFKIGSLLGLLAPHSCDTLPTIRQAAASSTIGLFYIKGIHLEVERLQGLQEGLESDDVQVQIKISSKIAKIVSKFIPNEEILMFLEEMLDGLESLNPTCTKACGIWMITVLKQQGAALEDQLLEILGTIYHHMPVLRQKEESFQFILEAISQIASFHMDTVVVNLLQKPLPFDRDTKTLWKALAEKPASSGKLLQALIDKLETELEDDIARVEAISVACAMYEVISMGTSVTGLYPELFTLLLKLVSCTLGQKMLTCPWSHRRHVMQQGEQQQIPDPCRLSTATLKCLQAQAMREGLAKESDEGDNLWTLLSSPSTHHIGVCSLARSMAVWQHGVILDIMEQLLSSLTSSSENYRITGAAFFSELMKEPILWKHGNLRNVLILMDQSAWDSNATLRQMAIRGLGNTASGAPHKVKKHKQLMLESIIRGLYHLARTEVVCESLKALKKILELLTDRDVSFYFKEIVLQTRTFFEDEQDDVRLTAIFLFEDLAPLTGRRWKIFFAEEIKKSLISFLLHLWDPNPKIGVACRDVLMVCIPFLGLQELYGVLDRLLDQDLPRARDFYRQFCVKLAKKNQEILWILHTHSFTFFTSTWEVIRSAAVKLTDAVVLNLTSQYVELLDREQLTTRLQALRQDPCISVQRAAEAALQTLLRRCKETSIPL

SEQ ID NO: 12936 - protein, 1585 aa, Homo sapiens
MTLSTEESIEMFGDINLTLGMLNKEDIVNKEDIYSHLTSVIQNTDILDDAIVQRLIYYASKDMRDNNMLREIRMLAGEVLVSLAAHDFNSVMYEVQSNFRILELPDEFVVLALAELATSYVSQSIPFMMMTLLTMQTMLRLAEDERMKGTFCIALEKFSKAIYKYVNHWRDFPYPRLDANRLSDKIFMLFWYIMEKWAPLASPMQTLSIVKAHGPTVSLLLHREDFRGYALGQVPWLLNQYKDKEIDFHVTQSLKQILTAAVLYDIGLPRSLRRSIFINLLQQICRAPEPPVKENEMKASSCFLILAHSNPGELMEFFDEQVRSNNEAIRVGILTLLRLAVNADEPRLRDHIISIERTVKIVMGDLSTKVRNSVLLLIQTMCEKSYIEAREGWPLIDYVFSQFATLNRNLEKPVKTNFHENEKEEESVRETSLEVLKTLDPLVIGMPQVLWPRILTFVVPAEYTEALEPLFSIIRILIMAEEKKQHSAKESTALVVSTGAVKLPSPQQLLARLLVISMPASLGELRGAGAIGLLKILPEIIHPKLVDLWKTRLPELLQPLEGKNISTVLWETMLLQLLKESLWKISDVAWTIQLTQDFKQQMGSYSNNSTEKKFLWKALGTTLACCQDSDFVNSQIKEFLTAPNQLGDQRQGITSILGYCAENHLDIVLKVLKTFQNQEKFFMNRCKSLFSGKKSLTKTDVMVIYGAVALHAPKKQLLSRLNQDIISQVLSLHGQCSQVLGMSVMNKDMDLQMSFTRSITEIGIAVQDAEDQGFQFSYKEMLIGYMLDFIRDEPLDSLASPIRWKALIAIRYLSKLKPQLSLQDHLNILEENIRRLLPLPPLENLKSEGQTDKDKEHIQFLYERSMDALGKLLKTMMWDNVNAEDCQEMFNLLQMWLVSQKEWERERAFQITAKVLTNDIEAPENFKIGSLLGLLAPHSCDTLPTIRQAAASSTIGLFYIKGIHLEVERLQGLQEGLESDDVQVQIKISSKIAKIVSKFIPNEEILMFLEEMLDGLESLNPTCTKACGIWMITVLKQQGAALEDQLLEILGTIYHHMPVLRQKEESFQFILEAISQIASFHMDTVVVNLLQKPLPFDRDTKTLWKALAEKPASSGKLLQALIDKLETELEDDIARVEAISVACAMYEVISMGTSVTGLYPELFTLLLKLVSCTLGQKMLTCPWSHRRHVMQQGEQQQIPDPCRLSTATLKCLQAQAMREGLAKESDEGDNLWTLLSSPSTHHIGVCSLARSMAVWQHGVILDIMEQLLSSLTSSSENYRITGAAFFSELMKEPILWKHGNLRNVLILMDQSAWDSNATLRQMAIRGLGNTASGAPHKVKKHKQLMLESIIRGLYHLARTEVVCESLKALKKILELLTDRDVSFYFKEIVLQTRTFFEDEQDDVRLTAIFLFEDLAPLTGRRWKIFFAEEIKKSLISFLLHLWDPNPKIGVACRDVLMVCIPFLGLQELYGVLDRLLDQDLPRARDFYRQFCVKLAKKNQEILWILHTHSFTFFTSTWEVIRSAAVKLTDAVVLNLTSQYVELLDREQLTTRLQALRQDPCISVQRAAEAALQTLLRRCKETSIPL

SEQ ID NO: 12937 - protein, 74 aa, Homo sapiens
MDVRGPEAPGGRALRDAAENLFQELQEHFQALTATLNLRMEEMGNRIEDLQKNVKDLMVQAGIENSIKEQMLKT

SEQ ID NO: 12938 - protein, 182 aa, Homo sapiens
MSGRSVPHAHPATAEYEFANPSRLGEQRFGEGLLPEEILTPTLYHGYYVRPRAAPAGEGSRAGASELRLSEGKFQAFLDVSHFTPDEVTVRTVDNLLEVSARHPQRLDRHGFVSREFCRTYVLPADVDPWRVRAALSHDGILNLEAPRGGRHLDTEVNEVYISLLPAPPDPEEEEEAAIVEP

SEQ ID NO: 12939 - protein, 144 aa, Homo sapiens
MRKIDLCLSSEGSEVILATSSDEKHPPENIIDGNPETFWTTTGMFPQEFIICFHKHVRIERLVIQSYFVQTLKIEKSTSKEPVDFEQWIEKDLVHTEGQLQNEEIVAHDGSATYLRFIIVSAFDHFASVHSVSAEGTVVSNLSS

SEQ ID NO: 12940 - protein, 74 aa, Homo sapiens
MRKIDLCLSSEGSEVILATSSDEKHPPENIIDGNPETFWTTTGMFPQEFIICFHKHVRIERLVIQSYFGKQILH

SEQ ID NO: 12941 - protein, 112 aa, Homo sapiens
MRKIDLCLSSEGSEVILATSSDEKHPPENIIDGNPETFWTTTGMFPQEFIICFHKHVRIERLVIQSYFVQTLKIEKSTSKEPVDFEQWIEKDLVHTEGQLQNEEIVVSEYTL

SEQ ID NO: 12942 - protein, 144 aa, Homo sapiens; identical to SEQ ID NO: 12939

SEQ ID NO: 12943 - protein, 138 aa, Homo sapiens
MGVSNQGCSRNARHQKARSMPLQDQHLALAILLELAVQRGTLSQMLSAILLLLQLWDSRAQETDNERSAQGTSTLLLSLLQTFQSIICGKDTPPSEGNMHLLSGPLSPSESFLRYLTLHKTTSLPLICNKRQLLSWPI

SEQ ID NO: 12944 - protein, 2612 aa, Homo sapiens
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGAFEVNFMDDVGQTLLNWASAFGTQEMVEFLCERGADVNRGQRSSSLHYAACFGRPQVAKTLLRHGANPDLRDEDGKTPLDKARERGHSEVVAILQSPGDWMCPVNKGDDKKKKDTNKDEEECNEPKGDPEMAPIYLKRLLPVFAQTFQQTMLPSIRKASLALIRKMIHFCSEALLKEVCDSDVGHNLPTILVEITATVLDQEDDDDGHLLALQIIRDLVDKGGDIFLDQLARLGVISKVSTLAGPSSDDENEEESKPEKEDEPQEDAKELQQGKPYHWRDWSIIRGRDCLYIWSDAAALELSNGSNGWFRFILDGKLATMYSSGSPEGGSDSSESRSEFLEKLQRARGQVKPSTSSQPILSAPGPTKLTVGNWSLTCLKEGEIAIHNSDGQQATILKEDLPGFVFESNRGTKHSFTAETSLGSEFVTGWTGKRGRKLKSKLEKTKQKVRTMARDLYDDHFKAVESMPRGVVVTLRNIATQLESSWELHTNRQCIESENTWRDLMKTALENLIVLLKDENTISPYEMCSSGLVQALLTVLNNVSLSSSKEQKYSFTPSVEINVFKTAFSENEDDESRPAVALIRKLIAVLESIERLPLHLYDTPGSTYNLQILTRRLRFRLERAPGETALIDRTGRMLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGWIDVTWDAGGSNSYRMGAEGKFDLKLAPGYDPDTVASPKPVSSTVSGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQLQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 12945 - protein, 171 aa, Homo sapiens
KVFLKAVAGNYHIFRHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 12946 - protein, 2610 aa, Homo sapiens
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGAFEVNFMDDVGQTLLNWASAFGTQEMVEFLCERGADVNRGQRSSSLHYAACFGRPQVAKTLLRHGANPDLRDEDGKTPLDKARERGHSEVVAILQSPGDWMCPVNKGDDKKKKDTNKDEEECNEPKGDPEMAPIYLKRLLPVFAQTFQQTMLPSIRKASLALIRKMIHFCSEALLKEVCDSDVGHNLPTILVEITATVLDQEDDDDGHLLALQIIRDLVDKGGDIFLDQLARLGVISKVSTLAGPSSDDENEEESKPEKEDEPQEDAKELQQGKPYHWRDWSIIRGRDCLYIWSDAAALELSNGSNGWFRFILDGKLATMYSSGSPEGGSDSSESRSEFLEKLQRARGQVKPSTSSQPILSAPGPTKLTVGNWSLTCLKEGEIAIHNSDGQQATILKEDLPGFVFESNRGTKHSFTAETSLGSEFVTGWTGKRGRKLKSKLEKTKQKVRTMARDLYDDHFKAVESMPRGVVVTLRNIATQLESSWELHTNRQCIESENTWRDLMKTALENLIVLLKDENTISPYEMCSSGLVQALLTVLNNSMDLDMKQDCSQLVERINVFKTAFSENEDDESRPAVALIRKLIAVLESIERLPLHLYDTPGSTYNLQILTRRLRFRLERAPGETALIDRTGRMLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGWIDVTWDAGGSNSYRMGAEGKFDLKLAPGYDPDTVASPKPVSSTVSGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQLQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 12947 - protein, 2610 aa, Homo sapiens; identical to SEQ ID NO: 12946

SEQ ID NO: 12948 - protein, 926 aa, Homo sapiens
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGAFEVNFMDDVGQTLLNWASAFGTQEMVEFLCERGADVNRGQRSSSLHYAACFGRPQVAKTLLRHGANPDLRDEDGKTPLDKARERGHSEVVAILQSPGDWMCPVNKGDDKKKKDTNKDEEECNEPKGDPEMAPIYLKRLLPVFAQTFQQTMLPSIRKASLALIRKMIHFCSEALLKEVCDSDVGHNLPTILVEITATVLDQEDDDDGHLLALQIIRDLVDKGGDIFLDQLARLGVISKVSTLAGPSSDDENEEESKPEKEDEPQEDAKELQQGKPYHWRDWSIIRGRDCLYIWSDAAALELSNGSNGWFRFILDGKLATMYSSGSPEGGSDSSESRSEFLEKLQRARGQVKPSTSSQPILSAPGPTKLTVGNWSLTCLKEGEIAIHNSDGQQATILKEDLPGFVFESNRGTKHSFTAETSLGSEFVTGWTGKRGRKLKSKLEKTKQKVRTMARDLYDDHFKAVESMPRGVVVTLRNIATQLESSWELHTNRQCIESENTWRDLMKTALENLIVLLKDENTISPYEMCSSGLVQALLTVLNN

SEQ ID NO: 12949 - protein, 776 aa, Homo sapiens
MSEAVRVPSPATPLVVAAPAPEERKGKESEREKLPPIVSAGAGATAGLDRGAKGQISTFSSFISAVSPKKEAAENRSSPAHLVFPNIKNVREPPPICLDVRQKQRTSMDASSSEMKAPVLPEPILPIQPKTVKDFQEDVEKVKSSGDWKAVHDFYLTTFDSFPELNAAFKKDATASFNTIEDSGINAKFVNAVYDTLLNTPQDVQKTVLKGIINSLLREWKGPRTKDDLRAYFILLQNPQFNNTSTYVIYAHLLRQIATLVEADHHFLVHWFKKLSQKRFKQLVERLLQFISLRLFPAKPEEFPPITKCSWWIPSAAKVLALLNTANNLVHPPLIPYTDFYNSTLDHIDLMEEYHTWQNFGNSHRFSFCQYPFVISVAAKKIIIQRDSEQQMINIARQSLVDKVSRRQRPDMNILFLNMKVRRTHLVSDSLDELTRKRADLKKKLKVTFVGEAGLDMGGLTKEWFLLLIRQIFHPDYGMFTYHKDSHCHWFSSFKCDNYSEFRLVGILMGLAVYNSITLDIRFPPCCYKKLLSPPIIPSDQNIPVGICNVTVDDLCQIMPELAHGLSELLSHEGNVEEDFYSTFQVFQEEFGIIKSYNLKPGGDKISVTNQNRKEYVQLYTDFLLNKSIYKQFAAFYYGFHSVCASNALMLLRPEEVEILVCGSPDLDMHALQRSTQYDGYAKTDLTIKYFWDVVLGFPLDLQKKLLHFTTGSDRVPVGGMADLNFKISKNETSTNCLPVAHTCFNQLCLPPYKSKKDLKQKLIIGISNSEGFGLE

SEQ ID NO: 12950 - protein, 426 aa, Homo sapiens
MEEYHTWQNFGNSHRFSFCQYPFVISVAAKKIIIQRDSEQQMINIARQSLVDKVSRRQRPDMNILFLNMKVRRTHLVSDSLDELTRKRADLKKKLKVTFVGEAGLDMGGLTKEWFLLLIRQIFHPDYGMFTYHKDSHCHWFSSFKCDNYSEFRLVGILMGLAVYNSITLDIRFPPCCYKKLLSPPIIPSDQNIPVGICNVTVDDLCQIMPELAHGLSELLSHEGNVEEDFYSTFQVFQEEFGIIKSYNLKPGGDKISVTNQNRKEYVQLYTDFLLNKSIYKQFAAFYYGFHSVCASNALMLLRPEEVEILVCGSPDLDMHALQRSTQYDGYAKTDLTIKYFWDVVLGFPLDLQKKLLHFTTGSDRVPVGGMADLNFKISKNETSTNCLPVAHTCFNQLCLPPYKSKKDLKQKLIIGISNSEGFGLE

SEQ ID NO: 12951 - protein, 147 aa, Homo sapiens
LSQKRFKQLVERLLQFISLRLFPAKPEEFPPITKCSWWIPSAAKVLALLNTANNLVHPPLIPYTDFYNSTLDHIDLMEEYHTWQNFGNSHRMAVRIKRNYTHTIILYMVKHNPKVMFYIATRGTLDSLSIILLKIHHFAFSFFHLLS

SEQ ID NO: 12952 - protein, 207 aa, Homo sapiens
MSEAVRVPSPATPLVVAAPAPEERKGKESEREKLPPIVSAGAGATAGLDRGAKGQISTFSSFISAVSPKKEAAENRSSPAHLVFPNIKNVREPPPICLDVRQKQRTSMDASSSEMKAPVLPEPILPIQPKTVKDFQEDVEKVKSSGDWKAVHDFYLTTFDSFPELNAAFKKDATASFNTIEDSGINAKFVNAVYDTLLNTVSIMTCK

SEQ ID NO: 12953 - protein, 780 aa, Homo sapiens
MSEAVRVPSPATPLVVAAPAPEERKGKESEREKLPPIVSAGAGATAGLDRGAKGQISTFSSFISAVSPKKEAAENRSSPAHLVFPNIKNVREPPPICLDVRQKQRTSMDASSSEMKAPVLPEPILPIQPKTVKDFQEDVEKVKSSGDWKAVHDFYLTTFDSFPELNAAFKKDATASFNTIEDSGINAKFVNAVYDTLLNTPQDVQKTVLKGIINSLLREWKGPRTKDDLRAYFILLQNPQFNNTSTYVIYAHLLRQIATLVEADHHFLVHWFKKQYSRLSQKRFKQLVERLLQFISLRLFPAKPEEFPPITKCSWWIPSAAKVLALLNTANNLVHPPLIPYTDFYNSTLDHIDLMEEYHTWQNFGNSHRFSFCQYPFVISVAAKKIIIQRDSEQQMINIARQSLVDKVSRRQRPDMNILFLNMKVRRTHLVSDSLDELTRKRADLKKKLKVTFVGEAGLDMGGLTKEWFLLLIRQIFHPDYGMFTYHKDSHCHWFSSFKCDNYSEFRLVGILMGLAVYNSITLDIRFPPCCYKKLLSPPIIPSDQNIPVGICNVTVDDLCQIMPELAHGLSELLSHEGNVEEDFYSTFQVFQEEFGIIKSYNLKPGGDKISVTNQNRKEYVQLYTDFLLNKSIYKQFAAFYYGFHSVCASNALMLLRPEEVEILVCGSPDLDMHALQRSTQYDGYAKTDLTIKYFWDVVLGFPLDLQKKLLHFTTGSDRVPVGGMADLNFKISKNETSTNCLPVAHTCFNQLCLPPYKSKKDLKQKLIIGISNSEGFGLE

SEQ ID NO: 12954 - protein, 365 aa, Homo sapiens
MNILFLNMKVRRTHLVSDSLDELTRKRADLKKKLKVTFVGEAGLDMGGLTKEWFLLLIRQIFHPDYGMFTYHKDSHCHWFSSFKCDNYSEFRLVGILMGLAVYNSITLDIRFPPCCYKKLLSPPIIPSDQNIPVGICNVTVDDLCQIMPELAHGLSELLSHEGNVEEDFYSTFQVFQEEFGIIKSYNLKPGGDKISVTNQNRKEYVQLYTDFLLNKSIYKQFAAFYYGFHSVCASNALMLLRPEEVEILVCGSPDLDMHALQRSTQYDGYAKTDLTIKYFWDVVLGFPLDLQKKLLHFTTGSDRVPVGGMADLNFKISKNETSTNCLPVAHTCFNQLCLPPYKSKKDLKQKLIIGISNSEGFGLE

SEQ ID NO: 12955 - protein, 1101 aa, Homo sapiens
MDECGSRIRRRVSLPKRNRPSLGCIFGAPTAAELVPGDEGKEEEEMVAENRRRKTAGVLPVEVQPLLLSDSPECLVLGGGDTNPDLLRHMPTDRGVGDQPNDSEVDMFGDYDSFTENSFIAQVDDLEQKYMQLPEHKKHATDFATENLCSESIKNKLSITTIGNLTELQTDKHTENQSGYEGVTIEPGADLLYDVPSSQAIYFENLQNSSNDLGDHSMKERDWKSSSHNTVNEELPHNCIEQPQQNDESSSKVRTSSDMNRRKSIKDHLKNAMTGNAKAQTPIFSRSKQLKDTLLSEEINVAKKTVESSSNDLGPFYSLPSKVRDLYAQFKGIEKLYEWQHTCLTLNSVQERKNLIYSLPTSGGKTLVAEILMLQELLCCRKDVLMILPYVAIVQEKISGLSSFGIELGFFVEEYAGSKGRFPPTKRREKKSLYIATIEKGHSLVNSLIETGRIDSLGLVVVDELHMIGEGSRGATLEMTLAKILYTSKTTQIIGMSATLNNVEDLQKFLQAEYYTSQFRPVELKEYLKINDTIYEVDSKAENGMTFSRLLNYKYSDTLKKMDPDHLVALVTEVIPNYSCLVFCPSKKNCENVAEMICKFLSKEYLKHKEKEKCEVIKNLKNIGNGNLCPVLKRTIPFGVAYHHSGLTSDERKLLEEAYSTGVLCLFTCTSTLAAGVNLPARRVILRAPYVAKEFLKRNQYKQMIGRAGRAGIDTIGESILILQEKDKQQVLELITKPLENCYSHLVQEFTKGIQTLFLSLIGLKIATNLDDIYHFMNGTFFGVQQKVLLKEKSLWEITVESLRYLTEKGLLQKDTIYKSEEEVQYNFHITKLGRASFKGTIDLAYCDILYRDLKKGLEGLVLESLLHLIYLTTPYDLVSQCNPDWMIYFRQFSQLSPAEQNVAAILGVSESFIGKKASGQAIGKKVDKNVVNRLYLSFVLYTLLKETNIWTVSEKFNMPRGYIQNLLTGTASFSSCVLHFCEELEEFWVYRALLVELTKKLTYCVKAELIPLMEVTGVLEGRAKQLYSAGYKSLMHLANANPEVLVRTIDHLSRRQAKQIVSSAKMLLHEKAEALQEEVEELLRLPSDFPGAVASSTDKA

SEQ ID NO: 12956 - protein, 181 aa, Homo sapiens
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKKMWTQTCQAAWGRVKRSPCLLRLCPARWPRPQCHPEEIPLAASPASSWVSSDCPERCRSVCFLHACELHNLSLTVHLLDLFH

SEQ ID NO: 12957 - protein, 108 aa, Homo sapiens
MASNIFGTPEENQASWAKSAGAKSSGGREDLESSGLQRRNSSEASSGDFLDLKTSGGKIENVDTDLPGSLGQSEEKPVPAAPVPSPVAPAPVPSRRNPPGGKSSLVLG

SEQ ID NO: 12958 - protein, 108 aa, Homo sapiens
MASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 12959 - protein, 154 aa, Homo sapiens
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 12960 - protein, 65 aa, Homo sapiens
MQSEVQRQPDRSIQNPLTVGSHTPCLTPPTMSCNNSQVWWCVPVVPATWEPEAGGSLESSSSRLQ

SEQ ID NO: 12961 - protein, 220 aa, Homo sapiens
MALSSVGRAWCPPGFIRQNGVCTDLDECRVRNLCQHACRNTEGSYQCLCPAGYRLLPSGKNCQDINECEEESIECGPGQMCFNTRGSYQCVDTPCPATYRQGPSPGTCFRRCSQDCGTGGPSTLQYRLLPLPLGVRAHHDVARLTAFSEVGVPANRTELSMLEPDPRSPFALRPLRAGLGAVYTRRALTRAGLYRLTVRAAAPRHQSVFVLLIAVSPYPY

SEQ ID NO: 12962 - protein, 329 aa, Homo sapiens
MMAPVVLTCHSTGIPAPTVSWSKAGAQLGARGSGYRVSPSGALEIGQALPIHAGRYTCSARNSAGVAHKHVFLTVQASPVVKPLPSVVRAVAEEEVLLPCEASGIPRPTITWQKEGLNVATGVSTQVLPGGQLRIAHASPEDAGNYLCIAKNSAGSAMGKTRLVVQVPPVIENGLPDLSTTEGSHAFLPCKARGSPEPNITWDKDGQPVSGAEGKFTIQPSGELLVKNLEGQDAGTYTCTAENAVGRARRRVHLTILVLPVFTTLPGDRSLRLGDRLWLRCAARGSPTPRIGWTVNDRPVTGLGLLGMGGTESQDTGRLRREGRWGDPT

SEQ ID NO: 12963 - protein, 153 aa, Homo sapiens
MRGASARPPLLGSEEPFCPASRSVREGGGGVSPPPGQPPCPEGRWGGQPPARPADPSGREVGGSAPCPASRPVREVRGASARPPLLGSEEPLCPASRPIWEGGGGVSPPPCQPPCPGGRGASARPPLLGNEEPLCPATTPSGRCTQQLVENGP

SEQ ID NO: 12964 - protein, 251 aa, Homo sapiens
MSAYGMPMYKSGDLVFAKLKGYAHWPARIEHMTQPNRYQVFFFGTHETAFLSPKRLFPYKECKEKFGKPNKRRGFSAGLWEIENNPTVQASDCPLASEKGSGDGPWPEPEAAEGDEDKPTHAGGGGDELGKPDDDKPTEEEKGPLKRSAGDPPEDAPKRPKEAAPDQEEEAEAERAAEAERAAAAAAATAVDEESPFLVAVENGSAPSEPGLVCEPPQPEEEELREEEVADEEASQEWHAEAPGGGDRDSL

SEQ ID NO: 12965 - protein, 251 aa, Homo sapiens; identical to SEQ ID NO: 12964

SEQ ID NO: 12966 - protein, 114 aa, Homo sapiens
MFGACYKQPLKPSGSEPPAEECRMTPRHAGCDVTEMQRILSQPTFTEHLLRAVCTKLANMYSTSTDCREHCRRGMKAKQLKAEAGRSCQRKGVPIQTPREHSWISCKKEFEANP

SEQ ID NO: 12967 - protein, 76 aa, Homo sapiens
MFGACYKQPLKPSGSEPPAEECRMTPRHAGCDVTEMQRILSQPTFTEHLLRAVLSTERGPYPDPKRAFLDLLQERI

SEQ ID NO: 12968 - protein, 121 aa, Homo sapiens
MFGACYKQPLKPSGSEPPAEECRMTPRHAGCDVTEMQRILSQPTFTEHLLRAVCLVNGKGSLSRPQESILGSLARKNLRRIHRVSLVMCVRPLSPSKAIISPVTCMYTSRWPEASEESQKK

SEQ ID NO: 12969 - protein, 154 aa, Homo sapiens
MFGACYKQPLKPSGSEPPAEECRMTPRHAGCDVTEMQRILSQPTFTEHLLRAVCTKLANMYSTSTDCREHCRRGMKAKQLKAEAGRGLVNGKGSLSRPQESILGSLARKNLRRIHRVSLVMCVRPLSPSKAIISPVTCMYTSRWPEASEESQKK

SEQ ID NO: 12970 - protein, 114 aa, Homo sapiens; identical to SEQ ID NO: 12966

SEQ ID NO: 12971 - protein, 449 aa, Homo sapiens
MMLSTEGREGFVVKVRGLPWSCSADEVMRFFSDCKIQNGTSGIRFIYTREGRPSGEAFVELESEEEVKLALKKDRETMGHRYVEVFKSNSVEMDWVLKHTGPNSPDTANDGFVRLRGLPFGCSKEEIVQFFSGLEIVPNGMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 12972 - protein, 551 aa, Homo sapiens
MDEGVNFKPTEAGRLMAWYYITFETVKKFYTISGKETLSDLVTLIAGCKEFLDIQLRINEKKTLNTLNKDPNRITIRFPMEGRIKTREMKVNCLIQAQLGCIPIQDFALTQDTAKIFRHGSRITRWLSDFVAAQEKKFAVLLNSLILAKCFRCKLWENSLHVSKQLEKIGITLSNAIVNAGLTSFKKIEETDARELELILNRHPPFGTQIKETVMYLPKYELKVEQITRYSDTTAEILVTVILRNFEQLQTKRTASDSHYVTLIIGDADNQVVYLHKITDSVLLKAGSWAKKIAVKRALKSEDLSINLISSEFVGLDIQQKLTVFYLEPKRFGNQITMQRKSETQISHSKHSDISTIAGPNKGTTASKKPGNRECNHLCKSKHTCGHDCCKIGVAQKSEIKESTISSYLSDLRNRNAVSSVPPVKRLKIQMNKSQSVDLKEFGFTPKPSLPSISRSEYLNISELPIMEQWDQPEIYGKVRQEPSEYQDKEVLNVNFELGNEVWDDFDDENLEVTSFSTDTEKTKISVLFHHMRCRIFLYQILLCPSSVHPP

SEQ ID NO: 12973 - protein, 830 aa, Homo sapiens
MIACFLWKICFLKNQMKLKMAPIKALCSQRFDDWKEKFGPIGLNCKELTGDTVMDDLFEIQHAHIIMTTPEKWDSMTRKWRDNSLVQLVRLFLIDEVHIVKDENRGPTLEVVVSRMKTVQSVSQTLKNTSTAIPMRFVAVSATIPNAEDIAEWLSDGERPAVCLKMDESHRPVKLQKVVLGFPCSSNQTEFKFDLTLNYKIASVIQMYSDQKPTLVFCATRKGVQQAASVLVKDAKFIMTVEQKQRLQKYAYSVRDSKLRDILKDGAAYHHAGMELSDRKVVEGAFTVGDLPVLFTTSTLAMGVNLPAHLVVIKSTMHYAGGLFEEYSETDILQMIGRAGRPQFDTTATAVIMTRLSTRDKYIQMLACRDTVESSLHRHLIEHLNAEIVLHTITDVNIAVEWIRSTLLYIRALKNPSHYGFASGLNKDGIEAKLQELCLKNLNDLSSLDLIKMDEGVNFKPTEAGRLMAWYYITFETVKKFYTISGKETLSDLVTLIAGCKEFLDIQLRINEKKTLNTLNKDPNRITIRFPMEGRIKTREMKVNCLIQAQLGCIPIQDFALTQDTAKIFRHGSRITRWLSDFVAAQEKKFAVLLNSLILAKCFRCKLWENSLHVSKQLEKIGITLSNAIVNAGLTSFKKIEETDARELELILNRHPPFGTQIKETVMYLPKYELKVEQITRYSDTTAEILVTVILRNFEQLQTKRTASDSHYVTLIIGDADNQVVYLHKITDSVLLKAGSWAKKIAVKRALKSEDLSINLISSEFVGLDIQQKLTVFYLEPKRFGNQITMQRKSETQISHSKHSDISTIAGPNKGTTASKTWEPRMQSSL

SEQ ID NO: 12974 - protein, 1114 aa, Homo sapiens
MEVPLPWLNIKIVYMAPIKALCSQRFDDWKEKFGPIGLNCKELTGDTVMDDLFEIQHAHIIMTTPEKWDSMTRKWRDNSLVQLVRLFLIDEVHIVKDENRGPTLEVVVSRMKTVQSVSQTLKNTSTAIPMRFVAVSATIPNAEDIAEWLSDGERPAVCLKMDESHRPVKLQKVVLGFPCSSNQTEFKFDLTLNYKIASVIQMYSDQKPTLVFCATRKGVQQAASVLVKDAKFIMTVEQKQRLQKYAYSVRDSKLRDILKDGAAYHHAGMELSDRKVVEGAFTVGDLPVLFTTSTLAMGVNLPAHLVVIKSTMHYAGGLFEEYSETDILQMIGRAGRPQFDTTATAVIMTRLSTRDKYIQMLACRDTVESSLHRHLIEHLNAEIVLHTITDVNIAVEWIRSTLLYIRALKNPSHYGFASGLNKDGIEAKLQELCLKNLNDLSSLDLIKMDEGVNFKPTEAGRLMAWYYITFETVKKFYTISGKETLSDLVTLIAGCKEFLDIQLRINEKKTLNTLNKDPNRITIRFPMEGRIKTREMKVNCLIQAQLGCIPIQDFALTQDTAKIFRHGSRITRWLSDFVAAQEKKFAVLLNSLILAKCFRCKLWENSLHVSKQLEKIGITLSNAIVNAGLTSFKKIEETDARELELILNRHPPFGTQIKETVMYLPKYELKVEQITRYSDTTAEILVTVILRNFEQLQTKRTASDSHYVTLIIGDADNQVVYLHKITDSVLLKAGSWAKKIAVKRALKSEDLSINLISSEFVGLDIQQKLTVFYLEPKRFGNQITMQRKSETQISHSKHSDISTIAGPNKGTTASKKPGNRECNHLCKSKHTCGHDCCKIGVAQKSEIKESTISSYLSDLRNRNAVSSVPPVKRLKIQMNKSQSVDLKEFGFTPKPSLPSISRSEYLNISELPIMEQWDQPEIYGKVRQEPSEYQDKEVLNVNFELGNEVWDDFDDENLEVTSFSTDTEKTKISGFGNTLSSSTRGSKLPLQESKSKFQREMSNSFVSSHEMSDISLSNSAMPKFSASSMTKLPQQAGNAVIVHFQERKPQNLSPEIEKQCFTFSEKNPNSSNYKKVDFFIRNSECKKEVDFSMYHPDDEADEMKSLLGIFDGIF

SEQ ID NO: 12975 - protein, 1435 aa, Homo sapiens
MLKSNDCLFSLENLFFEKPDEVENHPDNEKSLDWFLPPAPLISEIPDTQELEEELESHKLLGQEKRPKMLTSNLKITNEDTNYISLTQKFQFAFPSDKYEQDDLNLEGVGNNDLSHIAGKLTYASQKYKNHIGTEIAPEKSVPDDTKLVNFAEDKGESTSVFRKRLFKISDNIHGSAYSNDNELDSHIGSVKIVQTEMNKGKSRNYSNSKQKFQYSANVFTANNAFSASEIGEGMFKAPSFSVAFQPHDIQEVTENGLGSLKAVTEIPAKFRSIFKEFPYFNYIQSKAFDDLLYTDRNFVICAPTGSGKTVVFELAITRLLMEVPLPWLNIKIVYMAPIKALCSQRFDDWKEKFGPIGLNCKELTGDTVMDDLFEIQHAHIIMTTPEKWDSMTRKWRDNSLVQLVRLFLIDEVHIVKDENRGPTLEVVVSRMKTVQSVSQTLKNTSTAIPMRFVAVSATIPNAEDIAEWLSDGERPAVCLKMDESHRPVKLQKVVLGFPCSSNQTEFKFDLTLNYKIASVIQMYSDQKPTLVFCATRKGVQQAASVLVKDAKFIMTVEQKQRLQKYAYSVRDSKLRDILKDGAAYHHAGMELSDRKVVEGAFTVGDLPVLFTTSTLAMGVNLPAHLVVIKSTMHYAGGLFEEYSETDILQMIGRAGRPQFDTTATAVIMTRLSTRDKYIQMLACRDTVESSLHRHLIEHLNAEIVLHTITDVNIAVEWIRSTLLYIRALKNPSHYGFASGLNKDGIEAKLQELCLKNLNDLSSLDLIKMDEGVNFKPTEAGRLMAWYYITFETVKKFYTISGKETLSDLVTLIAGCKEFLDIQLRINEKKTLNTLNKDPNRITIRFPMEGRIKTREMKVNCLIQAQLGCIPIQDFALTQDTAKIFRHGSRITRWLSDFVAAQEKKFAVLLNSLILAKCFRCKLWENSLHVSKQLEKIGITLSNAIVNAGLTSFKKIEETDARELELILNRHPPFGTQIKETVMYLPKYELKVEQITRYSDTTAEILVTVILRNFEQLQTKRTASDSHYVTLIIGDADNQVVYLHKITDSVLLKAGSWAKKIAVKRALKSEDLSINLISSEFVGLDIQQKLTVFYLEPKRFGNQITMQRKSETQISHSKHSDISTIAGPNKGTTASKKPGNRECNHLCKSKHTCGHDCCKIGVAQKSEIKESTISSYLSDLRNRNAVSSVPPVKRLKIQMNKSQSVDLKEFGFTPKPSLPSISRSEYLNISELPIMEQWDQPEIYGKVRQEPSEYQDKEVLNVNFELGNEVWDDFDDENLEVTSFSTDTEKTKISGFGNTLSSSTRGSKLPLQESKSKFQREMSNSFVSSHEMSDISLSNSAMPKFSASSMTKLPQQAGNAVIVHFQERKPQNLSPEIEKQCFTFSEKNPNSSNYKKVDFFIRNSECKKEVDFSMYHPDDEADEMKSLLGIFDGIF

SEQ ID NO: 12976 - protein, 138 aa, Homo sapiens
MLKSNDCLFSLENLFFEKPDEVENHPDNEKSLDWFLPPAPLISEIPDTQELEEELESHKLLGQEKRPKMLTSNLKITNEDTNYISLTQKFQFAFPSDKYEQDDLNLEGVGNNDLSHIAGKLTYASQKYKNHIGTEIAP

SEQ ID NO: 12977 - protein, 728 aa, Homo sapiens
SQAWRSSEGLINRRSTGLGAVRREIYDKVQFSTMLKSNDCLFSLENLFFEKPDEVENHPDNEKSLDWFLPPAPLISEIPDTQELEEELESHKLLGQEKRPKMLTSNLKITNEDTNYISLTQKFQFAFPSDKYEQDDLNLEGVGNNDLSHIAGKLTYASQKYKNHIGTEIAPEKSVPDDTKLVNFAEDKGESTSVFRKRLFKISDNIHGSAYSNDNELDSHIGSVKIVQTEMNKGKSRNYSNSKQKFQYSANVFTANNAFSASEIGEGMFKAPSFSVAFQPHDIQEVTENGLGSLKAVTEIPAKFRSIFKEFPYFNYIQSKAFDDLLYTDRNFVICAPTGSGKTVVFELAITRLLMEVPLPWLNIKIVYMAPIKALCSQRFDDWKEKFGPIGLNCKELTGDTVMDDLFEIQHAHIIMTTPEKWDSMTRKWRDNSLVQLVRLFLIDEVHIVKDENRGPTLEVVVSRMKTVQSVSQTLKNTSTAIPMRFVAVSATIPNAEDIAEWLSDGERPAVCLKMDESHRPVKLQKVVLGFPCSSNQTEFKFDLTLNYKIASVIQMYSDQKPTLVFCATRKGVQQAASVLVKDAKFIMTVEQKQRLQKYAYSVRDSKLRDILKDGAAYHHAGMELSDRKVVEGAFTVGDLPVLFTTSTLAMGVNLPAHLVVIKSTMHYAGGLFEEYSETDILQMIGRAGRPQFDTTATAVIMTRLSTRDKYIQMLACRDTVESRLHAH

SEQ ID NO: 12978 - protein, 97 aa, Homo sapiens
MSSDNQWSADEDEGQLSRLIRKSRDSPFVPIGIAGFVTVVSCGLYKLKYRRDQKMSIHLIHMRVAAQGFVVGAVTLGVLYSMYKDYIRPRFFSESKK

SEQ ID NO: 12979 - protein, 200 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 12980 - protein, 88 aa, Homo sapiens
MPKRKAKGDAKGDKAKRRSTRLSAKPAPPKPQPKPKKAPAKKGEKIPKGKKGKADAGKEGNNPAENGDAKTDQAQKAEGAGVAKASDE

SEQ ID NO: 12981 - protein, 191 aa, Homo sapiens
MGKTNSKLAPEVLEDLVQNTEFSEQELKQWYKGFLKDCPSGILNLEEFQQLYIKFFPYGDASKFAQHAFRTFDKNGDGTIDFREFICALSVTSRGSFEQKLNWAFEMYDLDGDGRITRLEMLEIIEAIYKMVGTVIMMRMNQDGLTPQQRVDKIFKKMDQDKDDQITLEEFKEAAKSDPSIVLLLQCDMQK

SEQ ID NO: 12982 - protein, 183 aa, Homo sapiens
MGKTNSKLAPEVLEDLVQNTEFSEQELKDCPSGILNLEEFQQLYIKFFPYGDASKFAQHAFRTFDKNGDGTIDFREFICALSVTSRGSFEQKLNWAFEMYDLDGDGRITRLEMLEIIEAIYKMVGTVIMMRMNQDGLTPQQRVDKIFKKMDQDKDDQITLEEFKEAAKSDPSIVLLLQCDMQK

SEQ ID NO: 12983 - protein, 354 aa, Homo sapiens
MAEVLRTLAGKPKCHALRPMILFLIMLVLVLFGYGVLSPRSLMPGSLERGFCMAVREPDHLQRVSLPRMVYPQPKVLTPCRKDVLVVTPWLAPIVWEGTFNIDILNEQFRLQNTTIGLTVFAIKKYVAFLKLFLETAEKHFMVGHRVHYYVFTDQLAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVRNP

SEQ ID NO: 12984 - protein, 41 aa, Homo sapiens
LEEQPECREEKRGSLHVWKSELVEVEDDVYLRHSSSLTYRL

SEQ ID NO: 12985 - protein, 1215 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 12986 - protein, 103 aa, Homo sapiens [sequence omitted]

SEQ ID NO: 12987 - protein, 103 aa, Homo sapiens [sequence omitted]

SEQ ID NO: 12988 - protein, 714 aa, Homo sapiens
MPAAAGDGLLGEPAAPGGGGGAEDAARPAAACEGSFLPAWVSGVPRERLRDFQHHKRVGNYLIGSRKLGEGSFAKVREGLHVLTGEKVAIKVIDKKRAKKDTYVTKNLRREGQIQQMIRHPNITQLLDILETENSYYLVMELCPGGNLMHKIYEKKRLEESEARRYIRQLISAVEHLHRAGVVHRDLKIENLLLDEDNNIKLIDFGLSNCAGILGYSDPFSTQCGSPAYAAPELLARKKYGPKIDVWSIGVNMYAMLTGTLPFTVEPFSLRALYQKMVDKEMNPLPTQLSTGAISFLRSLLEPDPVKRPNIQQALANRWLNENYTGKVPCNVTYPNRISLEDLSPSVVLHMTEKLGYKNSDVINTVLSNRACHILAIYFLLNKKLERYLSGKSDIQDSLCYKTRLYQIEKYRAPKESYEASLDTWTRDLEFHAVQDKKPKEQEKRGDFLHRPFSKKLDKNLPSHKQPSGSLMTQIQNTKALLKDRKASKSSFPDKDSFGCRNIFRKTSDSNCVASSSMEFIPVPPPRTPRIVKKPEPHQPGPGSTGIPHKEDPLMLDMVRSFESVDRDDHVEVLSPSHHYRILNSPVSLARRNSSERTLSPGLPSGSMSPLHTPLHPTLVSFAHEDKNSPPKEEGLCCPPPVPSNGPMQPLGSPNCVKSRGRFPMMGIGQMLRKRHQSLQPSADRPLEASLPPLQPLAPVNLAFDMADGVKTQC

SEQ ID NO: 12989 - protein, 253 aa, Homo sapiens
MGLSPGAEGEYALRLPRIPPPLPKPASRTASTGPKDQPPALRRSAVPHSGLNSISPLELEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCRARPDGRSEGCWSSYFSCSG

SEQ ID NO: 12990 - protein, 269 aa, Homo sapiens
MGLSPGAEGEYALRLPRIPPPLPKPASRTASTGPKDQPPALRRSAVPHSEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQVEHALMEGAKAAGAVISAVVDSIKPKPITA

SEQ ID NO: 12991 - protein, 279 aa, Homo sapiens
MGLSPGAEGEYALRLPRIPPPLPKPASRTASTGPKDQPPALRRSAVPHSGLNSISPLELEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQVEHALMEGAKAAGAVISAVVDSIKPKPITA
